United States Patent 11,583,558 (METHODS AND COMPOSITIONS FOR TREATMENT OF MICROBIOME-ASSOCIATED DISORDERS) - sequence listing, part 7

SEQ ID NO: 8 - DNA, 3806602 bp, Clostridium butyricum WBS-01 (residues 1-1,903,301 of 3,806,602)
atattgaagatcagataaaggaaatagataaagatgaatggaaggggattgctgtttatgttgatcatgtaaagggaaaaatacatcctgttacttatgagttaataggaaaagcaattgaattggcagaaaaaaaatcagcaggtttatgcagtatttattggaaataatatattaagtgaagcagaagaattattacattatggagttgataaagtatttgtatatgatgatgaagaactaaaagactttagaattgaatcgtatacatctgcatttgaagattttataaacaataataagccaacagccatactagttggtgcaacaacaataggaagatctttagcacctagggttgcagctagatttaaaactggtttgactgctgattgtactgttttagaaatgaaagaaaatacagatttagttcagataagaccagcatttggaggcaatataatggctcaaatagtaactccaaattcaagaccacagctagcaacagttagatataaagttatggaggcaccagaaagatcagagactgcaaaaggagaaatagtaacatgtaatgttgataaggaaaaattaaaatcaggaataagcgttattgaaataaaagaaaaaattatagaacgtggaataagtgatgcagaggttattgttgcagctggaagaggcgtaaaatcggaaaaggatttgaaaatagttaaggagttagcagaagcattagatgctgaatttgcatgtacaagaccacttattgaggctggatgggttgatgcaaaaagacagattggattaagtggaagaactgtaaggcctaaattaataataacttgtggaatatctggagctgttcaattttcagctggaatgaacaactctgactgtattatttctattaatactgattcaaaagcacctatatttaaaatttctcactatggaattgtaggggatatatatgatatcattccacaattaacagagaaaatcaaaatggtaaaggagagatagagatatgggcaataaatacaaaacattgaaatagaagattatgaaagcatattagaattaataggcaatgataaagaaagagtattttttagagatgaagtaaatgaagattatagtcacgatgaacttggtggaataaagaagatgccagatatagtagttcaagtattatgtactgatgaagtatcaaaaataatgaaatatgcttacgataataatataccagtaactccaagaggatctggtacaggacttgttggggcagcagttccattagagggcggaatagttatagatttaagtaaaatgaataaaatattagagctagatgaagagaatcttacattaacattagaaccaggcgttttattaatggaaattggaaaatagttgaagaagcagatttattttatccaccagatccaggtgaaaagtcagcaacaataggtggaaatataagtacaaatgcaggtggtatgagggcagtaaaatatggtgttacaagagattatgtgcgtggacttgaagtggttcttcctaatggtaatatagtaaatttaggtggaaaggttgttaaaaacagctctggatatgcattaaaggatttaatgattggatctgaaggaactttaggaatagttacaaaggcaatactaagactacttcctttaccattaccaaaaaatctttaagccttttaattaatacccttgaaaatgcaataaaaacagttcctaaaataattaaatcaaaatctataccaacagctattgaatttatgcaaagagatgctattttagctgcagaggaatttttaggaaagagttttcctgataagtcatcagatgcgtatttgttattgacttttgatggtaattctactgaagaaatagaaaaggattatgaaaaagttgcagatatctgcttagaatctggtgctatagatgtatttatatctgatacagaagaaagacaagaagcaatatggtctgcaagaggatgttttcttgaagctattaaagcattaacaacagaaatggacgaagttgatgttgttgttccaagaaataagatagatcagtttgttacatttacacataatcttgaagctacaagtggcgtaaggataaagagttttggtcatgcaggtgatggaaatcttcatatttatatattaagagatgagttaaatgacaatgagtgggatgaaaaaatacattctataatgaagatgatgtatgataaagcacaatctttaagaggacaagtttctggtgaacatggaatagggtttgcaaagaaatcttatttacaatcatcattaccagatgattgtatagaaataatgaagggtataaaatctgcatttgaccctaaaaacattttaaatcctggaaaggtctgtgaataagcataaaatttatatttacaattttatattaatattataaataaagaatatgttaaaaataagctctggaagccaaatggtccagagcttttgttgcaattaagaacagggtatgattaaatggttaatggttacattttagcaaaatgtttttttatttgatgattatagattaaaaaatagattaaaaaatagattaaaaaggagacatttacttgaaagaaaaagatataaaattaactgataataatattatagaaatggatataaataagaaagaaaagcacgaatgttataaatgcggtgaagaagcaattttttataatacagaagttgaaaaatggatatgtgaagattgcaaaaatattgaagatgagttagataaacttgcagcaaaaatggagaagaagcttagcaaaagggtatattcttttgatttaaaagaacttattgaatgtttatcaaaagatgagatatataatatagctagaaacttaggcgttgcaaaaatttctggtttaaataaagataaattagctgaaaagcttatagaagagtataaacctctaatagaaaagagaatagggttatttgaagaagaaagatataaaatattaaagagctatattgataataaaggtgtaaagaattttgatgatatagatgaagaagaagctgataagagtgcatattttatacaacaaggtataatataccctacagttaagaatgacgagtcaatgttcttgatgcctaaggttgttcaaaagattattaaagataagaatgatatagattatagacgaatattaaaaggtaatacagagttgattaatatatacagaggtatgaacaaagcatatggtatattaaaagttgaagatgccgtgaagatgcttgaaagatttaatgaaaatactgatgtaagcttactggaattacttagagaagcatcatattattataacgaatttagagaagaaaatagttacttcataaataatgaaatagataattatgaagaagttttaaatgatataaaaaaagaagatataaaggaatatgcagttatatcaaaagaagaattattgagtatgaacggagaaaactgggtttacaatagtaaagcaggaaagtcattctataaagaatttacatctatgtttagtgtagataaggatatgacaattgctatgatggatgatttggctcttgatgttcaagaattagaaccttcagaggctgttgataaaatgattgaacttattaatatagacaatgaagaagttagatttgtagcatcaaaaatgatgaataagtttgttaataagataagattatggaaattaaaaggtatttcaaccaattatgcaaaagcaaatgttataagcgaagtatcaaacaaggttgttggaagaaatgatccatgtacatgtggaagtggaaagaaatataagaagtgttgtggaagaaatggaaatgtagttgtacttcctataaaataacttttaaaaatataagaatatttaagtacataaaattaataagtgaatagttatattgacataaaagatataaaatgataaaattttaccaaagcgaagatgttttaaacatcttcgctttcttttttttgtttttgtgtaaaactgttattatttaaggaggcaattttatgattaagacagtagtatcggttggtcttccagttgatgaaaatatgattataagaaaaaacactttaattccagaagaaattaaaggagatgaaaagagaatttgtatcgttacaggaactcatggagatgagcttgaaggacaatatgtatgctatgaattaaatagaatcataaacagcaatattgataagttaaaaggaatagtagatatttatccagcattgaatccactcggtatagattcgattcaacgaggaataccaatgtttgatttagacatgaatagaatatttccaggtaatgaaaatggtgctatggctgagcatgtagcatctcagataatatctgatattaaaggtgcggatatgtgcattgatattcatgcaagtaatatttttttaagagaaataccgcaagtaaggataaacgaaaataataaagatacacttatgaattatgcaaaattattaaatacagattttatatgggttcacggttctgcaactgttttagaagcaacccttgcatatagtttaaattcaattaatgttcctacacttgttgttgaaatgggagtgggaatgaggataacagaaaaatattgcaatcagcttgttgagggtatttttagacttatgaaagaaattggaatttgggctggagaaacaaaagtaattaaagagcctattatttcaactgatagagaagttggatttgcaaatgcaaatagttcaggaatatttattcctaaagcaactcattggagtagcataaaaaaaggtgaacttataggagatatattaaatgctcttacaggggaaatcgaagaaaaaatttatgcgccttgtgatggattgatttttactttaagagagtatcctgtagtttatactggttcattaattgcaagagttatcggaggtgtaaaaaatgattaaagatattattttttctttaaaatcaccttatagagatgagttaaaagttacaggatatagatttggaaaaggtgaaaaagctgcatgtataataggcgcaataagaggtaatgaaattcagcagttgtatatatgttcacagcttgtagatgcactaagaaagttagaagaaaaaggtcatataagtaaaaataatgagattcttataataccttcagtaaataattatgccatgaatataggaaaaagattttgggctttagataatacagatataaatagaatgtttcccggttatactcaaggggaaacaacacagagaattgcagcaggtgtatttgagaaggttcaaggatatacatatggtattcaatttgcaagcttttatatgccaggagattttataccacacgtaaggatgatggagacaggatatcaaagtcctagtcttgcaaatttatttgggcttcaatatgttttaataagaaagccaaagccatttgatacgacaacacttaattataattggcagctttggaacacaaatgctttttcagtatatacgaattgtactgatgagatagatgaagtttctgctagacatgcggttactgctgttttaagatttttaacaagaatgggagtaataaaatataactgccatagtggatatatagcaagtataattgaagaagataatttaaagcctattatggctaagagtgcaggaatttttagaagaaaagtaaatccgggagactgtgttgaaagaggagatattctagctgaggtattagatccatatgaaggattagttttatcaaatgtggtatctactactaatggaatagtattttttgcacataatgcaccacttgttatagaaaactcagtagtatttaaaataataagaagaatacatgattaaaaaaagatttaaggaaaatttccttaaatctttttacattattagcattattcacaaatagagaattttcaacatataatttttttgaaatcctgataaccagaagaaatatttgtagagaataaaggttttgtgaaaaatttgaatagataacataaagttatagcaaattatataaaatttaaatttttattgtataattaaaaaaggtttagataaggtgggattattatgaaaatattagttgttgatgatgaaaaaagtatagttaatttgattagaatgaatttagaacttgaagggtaccaagttgttataagcatgaatggaatagatgcaattgagaaatttgaaactgaaaggccagaattagtaatacttgatattatgttgccagatataagtggtcatgaagtcattcaaaaatttcagaaaatagatagtgaaattcccgtaataatgcttactgcaaatagtcaaataaatgataagctattaggtcttcaactaggtgcagatgattatataacaaagccttttaacagtatagagcttatgttaagaataaaagcaataacaaaaagaattaataagaaatacaatgggaaaaaggaaaataataatgaatttaaaataaaggggataagagttttaaaagatgaacgaaaagtttttattgatggagaagaaattattgccacttataaagagtttgatacattagtattaatgatggaaaattgtaataaggtttttacaagagataaacttttgaaaagagtatggggatatgaatttgaaggtaatactagagctgttgatattttgatacaaagacttagaaaaaaattaggggtttattcggaatgtttaaaaacaatttatggagtaggctatagatttgaattgtaaataatcggataaaagaataaggatgtgcttttgtgaaaaaagtaaatttaaagataaaagataagattatgcttatgaatatggggatattaataccagtaataacttttatatatataataataatgaataacatatatagtaatgtaataaatagtagtgttgattttttaatcaaagaaagttataatacgcagctatatatagaaggttatcttgaaaaggatcagaacttaactaaggaagcaaattttattaataaaggaccacttatcaatacatatttatcaaataagcttaactttaggattcaaacttatgataaaacaggaaacataatatctgattctgatatgaacaatcttagtctttatgatgaagatataaagaattctataaatggaaataaagcttatgttgttaaaaaaattgatcgtaatatgtatatattattttcaagtcctatatatgatgataatgtaactattggtggtgtaagatatatatatccattgcatagggaacaagaaattataaataatatgtttataattatgggaatagtagcttgtgtagcaatatttatatcatggctgttaagtagattattttcggaaaaaatatctaatccaataaaggaactaaagattgcatctgaaaggattagtaaaggagattataataataatatagaaattgaaagtggagatgagatagaagatttagcaaaagcttttaacataacaacagagagtataaagatttacattgaaagtttaaaaaatgagaaacaaaaacagaaagatttcttggataatgttactcatgaatttaaaaccccattaaccgccataataggatattcagaattaatacctagattagaaaataagaatgatatagaggaaagttcagtttatataaaaaaagaaggggaaagattattaaagttagttgaagaacttcttgatttatcaaaacttgggaaatctgaatttaatgttaatagaagtaagaatgatttagctacaataatagaagaagctttaaatattatacaaccaagacttcaaaagtatgatatagatataataaaaaaattatgcaatgtaaatttatatatagacaaggataaaactaaacaggtaattctaaatgttttagataatgctataaagtatagcgaatgtacaagtattatattaaaaattaaagagactaataatgatatagaattaacaattatggatgatggtataggtatagaaaaaagtcatttaaataaactttttgaaccaatttatagagttaataaggcgaattctagaagtaaaaatggaaatggattaggtctttgtatatgtaaagaaataatgagaaaacaagatggagacatagagatatacagtgaagaaaataaatggactttagttaaaattatttttagtaaattatataaaaattcatgaaaacgttaaaatgttacaattatgaaacatttgcgaaatatttttgataaattaaggttttattatataggaggagtaggaagtgaaaaaaatcaatttaagagttaagatttcaggcatatatattgttatgcttcttatttgtattattataataaatcttaattatagctttttatacaataaggtaataataattaacgataaggatgaagtggtaaagaaaataaatatgtctatacctataaaagttgaaatttctaatgaaaggtggggggaatatttttttgaagatgagacttcaatacaacaaatatggaattcaataaatgaaattacaaaggactcttctgttgatgataattatgattcggaagttagtgatattaaaattaatggaactatttattatttaaatggaacaaaagataattttgaaataagcaataaattatctttaaataataatacttataatgataaatataaaataccattaataaatagtttaaaaaataaattgcttggatatttatattcaacatctaacatagtaaaaatcataaattccaataatgagataatcataattgataggaataaaaatattaaagagctagacaaatctcataaagaaaatatagaaaatacgataaatgattcattaaagcttgagaacaataaagagataataaatttattgaaaagtaaaacagaagcgttatatcatattaagatttatctggataatgataaagacaatctttcaaaagttaaatgctctaatttagtaaatattgatgtatatgagaatgattttttcgttgttcaatatatgggtgatgaaaatggacgacatatatattttagaggaaaactaaatgatgtgtgtaagaaaatatttataaatgaattataaataggtattaacttaggaggattgaattaatgaagataacaaaaactgtttattgcgtatttttaataattatgtgtttaaatatgttagcttgcaatgacaaaaaagagaatataacgtttaatgatggatatccaaatttaaaaggaaaacatattgttgtatatgttgcgtctagagatgaggtaggaagtgcaattttagaactttttaaagaaaaaacaggatgcacttatgaatatttaaaaatgtcaactcaggaatctttatcaagaatagaatctgagaggaaagatcctaaggcagatatatttttaggtggaacatgtgatgttcatgttttgatgaaaaaagaaaatctttcagaaaaatatatatctgaaaattatgatagtatcccagaaaaatataaagacagagagggatattggattggttttgaagttagtcccctatcaattgcaattaatagcgataggtgggaaaaggaattcgctaataaaggaatagcaatgcctaaaacttatgaggatctactaaatccaatatataagggagaaatcgtaatagcagatccgaatacttcaggaacagcttatacaatgttagcatcaattattcaaagtatgggagaagataaagcaaaagaatttttaaagaaaatgaaagataatgttggtgaatttacaactaatggatatacgccagcgcaaaaagttgcaaccggagaatatctaataggtattaattttttaagcgatcagcttttgattaaggattcaggttttaatattgtaactaatgtacccaaagatagtggatggaatatagatgcaatttccaagattaaaaatggacctaatggcgatatcggaaagtatttcatagacttttgtacaactaaagaagtagaggaaacattaaataatatatcctttgcaatgttaacacgtcaagatacaagagatataggtggaataaagcttaatcaattagatatatataatgattacaattttgtaaaggctagcaatgatagagaatggttgattaatatgtggaacaatttaaattaatatgtttttataataggcaatactcctacttcaattaaaaagttatttcattatatacttacaatggaggaagaaatatgaataatataataaaattttttgatataaataaaagagaagtatctgttcctattgaagaacaaagacaaagatggttaaaagaatttttaaaggcatttttagttgtattttcagtgtatgcatgtatgtactttgttagaaacaatcttaaagcagcacaaccattattgaaaaatcaacttggatttacaacatcagaacttggttatataggttttggattctctataacttatgctatggggaaaactattttaggatattttgttgatggtaaaaatgcaaagcgtataatatcaacattactaataatgtctgcaacaatggtatttataataggtattattttattgtcaggtaataaagcggttggaacaatattagtattttggggattaagtggattttttcaagcgccaggtggtccaagttcttattcaactatttcaagatggacacctactaataaaagaggaagatttttaggattttggaatatgtcacataatattggtggggcattagctggaatgatagcattgtttggagcaaatacattttttcatggtaatgtagcggggatgtttatagttccagctatagtaggaatttgtgtaggttttgttttactttttgttggaaaagatgagccacaagaattaggctggaattcagcagaagaaatatttgatgaacctagggttcaaagtgatgctgaaatagaagaaatgagtaagtttgaaatatttaaaaaatatgttttaactaatccttggatatgggttttatgtatagcaaacgtttttgtttatatagtacgtattggaatagataattgggctccattatatgttacagaacaattgcattttgcaatgaatgatgcagtaaatacaatattttattttgaaataggagctcttttaggaagtttaacttggggatatgtatctgatttactaaaaggaagaagagcaatagttgctgtattttgtttgattttaacaggatttgctgtgttaggatatagatatgctacaagcgttacaatggtaaatatttcattatttgctcttggtgcattaatatttggacctcaattattgattggggtatcacttattggatttgctcctaaaaaatcaattgcagttgccaatggattgagtggtacttttggatatttatttggagattctacagccaaggttgcattatcaaaaatagcagatcctaaatcatcaggtataactattggaagtgtaactcttcatggttggaatgatgtgtttgtagtgttttatggagcacttattattggaataactcttttattaattgtagcttatgcagaggaaaaaagaataagaaatatagagaaaaaagaatgtgaatatagagaattagcagcataacacaatactagtatagagttataagcgaaaatttaaaataatagaccatattaagttgaagttatttaatcaatttaatatggtctgtttttctgtattagtgattttgtattcacatttataattcacaaatagcaaattttcaacatataatgaactaatatcattacatggagttgaaagtgcgtgatatacgggctgattttagctggaggaaagggaagtaggctgtatcctttatcaagagcaggagcgccaaaacaatttctaaagctcataaatgataaaagttttttagtcaatacagttgataggataacccctataataaacaaagaaaatatctatgtggtaacaaatatggagtataaggataaggttaaaaatgaactttctgatattaatgaaaataatatttttgtagagcctgctaataaggagactgacttgtagacgataaaggtctttttgaaaaattgggatggatagtatttattttggaaatgaaacactaaagaattcctcggtatatggagagtataaatgtcaagataaatatggttctttccggacttagctgaatcttctataatattcaagtttaagtactttagtttttaatgtattaaaattgcaacgtcaatacataatttttttattactttaattttatttactgaaccttcagctaatccgttattataatcataatggatagcattttcaactgctactttctctctttttataccattaacaaagctatttatttcttttatatttaaactaagtacattatctatccagctatctaattttgaagcagttttagtagttaatatattcctaaattcattaactactttaagaattttctctaaatctggatattgtaaaaatacctgtttaagtacatcctttgatatttcttttacagattcaactgaactgtagagtaatttaataatggactgtctctctagtatgactatttcgtttccaataaaataatttctataataggcggaactggaaagaaaacagaatggagacatataaaacacatatcatatttatcattgagaaaaagatggcaaaaatgtaacatataaatatactaggcatgaagataataaagttatagtagaaacagtagaacctcatgaatttttgaaaaaagttataatacacattccagaaaagcattttaagatgattaggtactttggaatttactctagaagaagtagaaaaaaagatgtttttataaaaatgttagatgaaaaaatcttaagtataaggaaattaatatctaagtgggagtatagagtgcttgcagcatctggggtagatccatgtaagtgtcctaaattcggacatagaatggagttttatgatatagtttatgagaggtatggttctattagagagtatttaagaaaaaagtttattaaaaaacaaaaggaaaaattaaaaaaaaccattgaactatatgcaattacaaaaggaataatgtatggtaaaatgaatccgacaacaacgtagttggagggttagacaatgaaggaagaagaaatactatatgtttgtgtaaaatgtacatatgaagaaaatataccgaaggaggttgtagaatactttgatgagatggatcaaagtaacatagatgagcctccttgtttttcatgcgaaaaatgtggcggtataatgagacctaaagaatataaaggtatatacggaaaaacttataaatcgtaatatgaaaaccatagagaatttgaaaactctatggttttttagtcaatttaaaatattttctccgaaggagcgtggcgcagccacttttttatattgtttaactttcagtttcaattgttggtgtcattttcaaatatcaagttttttcgtgaattttcttatgtctattttaagcgcatttttatactaatagcgtaagtttgatatataatttgaataatgaaatatttgtataaaatttgaaaataatgtaatataatattataaatgtattaaacttgaaaaaataaataaaaaacaagtcgccaatatgctcaacctagtaaacttattcgtatttgggtgttagtaatatattttttttcttatttgattacacaatatatgcataaatataatcaatgttaatagtaaaaatattattatcaaaagcttgtaaatatttgcgggttttatttttgatggaggtataaatgaccaaagtgtagtgagataatagtcattattaaactgatttatgataataatgactataataacagatggtataagatggaggaggataattatgttttcaattattatagtagaagatgattttatgcaaagagatattttaaaaaaaatgattctatcaatgcatgaatttatagaaatttatgaagctgatagtgaatcagcagctttacatataattaaaaagcagaatattaatatgtttttaatagatatcagtttaagagaatcttcaggattagagcttgcaataaagattagaaatatagataaatatcaatttaatcaaatcatctttttaacgactcatatggaatatataacacaagcatttaagcagacacattgttacgattatataataaagccatataatcaagaagatgtacaagatatgttagataagattataatgcacgaaaatagtctattaagtaacaggaataataattttatagatgaagaaaaagataaggaagttattataaatttaaaaaatggtatatatatagggataaaaataaaagatatattttttatagaggtgaaagataaaaattgtgaaataaatactgttaatggaatatatattgccagtaatatgagtttgaaaaaaatgatgaaattaattaattgtgaatacataattcaaagccatagggcttttgtagtaaataaaaattacatatctagaatagaaaaactagacgttaaattaagtaccatatattttaacaactactctaaaacagctcttttgggatataaatttaaagatgatgttatgtcagtgtttagagagggaaaagtgatattatgttaagtgattttattataaatagcattgatagctttaatataatttatttatgggtaattttaaccaagaaaaataataatatatttaaattattatctagtgtacttatcttttctgttttagttacagctattgagcaattagggttaaattttataattacatatatagctggtattatgacaattaaaattatatataagggttatttaaaagaagttatatcaggatatattttagtattgcttatagagataagtttaggtttaatattttctttatttattaataaattaatttatgatgatacatatatagccattattacagaattaataattttagttataacaattataagttcaaaaacaaagttatttaaaaagaatataatttttgaacttattgataacaatgctttaatttattttattgtagtatgtttttcatatgctagtgtatttaagattatttggaattatgatgatacaataattttaaataatttgttcagtatatcattaatattttgtacattagttatatcacaatttttaacttatttatatttacttaaagtaataaaagaaagagaaactttaaaaatttcaaatgaatataatgaagttatcgatgagatagttcaagaaattaaacaaagacaacatgattttgtaaattataaaaatacaataagaggaataatatcagttgtagatgagaaagatgtaaaatcagcaattaataattatataaaggatgaagaactgcatgataataaaataaatgaactcatatacatagataatgtagttattagatccataatatataggaatatatgcaaggcagaaaagtacaatgttaattttaaatataaaatagaaaataatatctttgataatatattaagttatcatgaaatatccaatctattaaataacttattaaataatgcttttgatgaggtattaaaggaagagtgtaataaaaaaatattgaagttaaaatttttaatgaagaaaaaacatctcatttaatagttaaaagtcaaatagtaaatcctaatgatattaacataaatgagatgttcacaagaggttattctactaaaaatacaacaggtacaagaggttatggcttgtacaatgtacaacaaatagttaacctacataaaggatatataaaattgaatgtggaatatgaagaaattatttttgatatttattataataattcttcaggataatctggttcccccacatgctagagcaacctgattttgatactaaattaaatagattaagtagtattgctgaaaaaacgtttatagattttgtcattgaaaacacctcctttcagagtaacaataattacttgaacaatttgaaaaaatatacttaaaaatatacaattacatattttggtgttagatattttaaaaaataatatgcaccaaaatgtaagtgatattaaagataatatttttaatgtcgctttattttttatgggtcttttttcattacggcaaggagcaaaagctattgttataatgaaatacattgcaaagaaaattatataaaaattaatatttagctttggagctaaattgcttaacaagaatattattaagaagtatagtgtgctaaacattaaacatgagtaatacgttttacaatgaagacctcccaataatggtcttgttgaatttaaaatgataaaagacaataagaataatggtatctcctttaacattaaaaaaattagaaatataattataaatttacttaagtcgcctaaaactacttcaagggtatactggattttcagtgtatctttttcagttaaagaagtattatttgtccttaagtattgagttataaaagttgatactgattttatcatttttacctcgcttgtattgtgatatggtatatatacttatataccatatcatgttaaaaatcaacactattggaataaaacgtataatttagataataaaaaattatgaatatataagtgttttgtgtttttaaaagatagaaattataacttcttgaaaatcatagaggcattatgtcctccaaagcctagtgaattagataagacataatttagcatagattttctccctttgtgaaaaacataatctagattacaatcttcatctttttctttaaatccaatagtggcaggtataaaattatcttgtaatgattttatacaaattatgctttctattgccccagaagctcctaataaatggccagtcatagatttagtagaacttactggaactctattattatctttatagaaaattttttcaataatttgtgattcaaacttatcattatacttagtaccagttccatgagcattaatatatgaaatatctttataactaatacctgcttcacgcaatgctaattcaattgctctaataccttgatgtaatgacggatcaggagatacaatattatatgcatcactagtcgagccatatccaacaacttcagcatatatttttgcatttcttttaagcgcatggtcaagctcttccagtataattgttccagagccttcccctagtacaaatccatttcgctcattatcaaaaggaatagaagctcttaatggatcagtacttctggatattgcttttagagaatcaaaactagaaatcaataaaggatttatgcatgcttcggatgcaccggcaattactatatcactatagcctgcttttatttgcctaaatgcttgccctatacaatctgttccagttgaacatgcggttattacagaagtacttcctccaaaagcttgaaattttattgaaatatttgctgctgccatattaacaatgtttaatggaattgtcattggagaaacatatgctggacctttattaaccagtttattatattcaattcctaaggtgctgcctccaacactagatccaaacactactgctagtcgttctttatcaatatttgattcattcaatcccgcatcattaaaagcttcatagctggaaactaatgcaagctgggtaaatctatctgtttttttcacatctataggcttaaaaaaattcttccagttataatctttaacttcggcagctacttttacattgctgttattagtatcaaatgttgcaatataatctataccgcattttgaagcagctattgaattccaaaaggcatctacattgtttcctaaaggagttattgctcctaatccagtaactacaactttcttcatgattttctcctaacttaaaaatataaatatttcttatatactattgtttttctaatgttttaagatttgaaataacgtcaactatatctccaatagtagagacgttgaaatcatcaggtatagtaacatcaaaagtgttttcaaattctgaaattagaacaaaaagatctactgagtctaagtctaaatcatcttctaattttgtttctaaggttatttcatttttacttattgaaaattgacttgaaaatatctcttgtaatttttctaacatttaatcatcctctttcttttttatttcaaatttagattttcatttcttaaattgatagaacaaatagtaattttaaattagttaagcttgtgctatttctaaaaagcaattatattaactcgtcgcaattacatactctcacaatgtcaaaattaaataaatatgtttttctttaaacgtacgaaatcattcattaaacggaaaaaatatacaaagtagtcaatatagttagaatttttgctttttataggttattttttacgtttagagtaaaaggcatttatttaatttaactattatgagagtatgtatttgataagtaactgaatagttacactgtattataaaatagtaacttgaggaatgcttaatatgttattgctcaagttaaatagaaaagggtgacgtagaaattctaatagttccctaaaatttaaatgaagggtaggagtatcaatgtatacacttgtaacaggtgcaactggttttataggaaaacggttagtaaagaaattggttgaagaaggaagaaaagttaggtgccttgtaagagatatatctaagactgaagaactaagctatcctagtgtggatttctttattggagatattagaaatctaaattctgtaaaaggagctatggaaggtatagatgtagtttatcatcttgcgggaaaggcaaatccaagtattgttaagccttataagtactatgaggaaattaatgtgataggaactagaaatgtattagacgcatctctatcaaataaaggaattaaaaaaattgttcttatgagttctattgcagcaactggtccgtcaagagattcaaatctattaaatgaaaaaagcactttaaaaccaattactaagtatggagaaagtaaggtgcaagtagaaaaaatggcccaggaatatcatagaaaacataatattcctatagtggtaataagacctccaatggtatatggaataggtgataaggattgggtaagtttcttcaaaatggtaaaggtttctgcagaatttaagaagtatttacccatacctggaaatcatgagaatttatttgatttctgttttgtagataatcttgtagatggcttaatcggagcagaaaaaagcagtaaaacaatgggacaaatttattttttatctgatgaccgtccatacaaattaaacgaaatattatcagcaataactaaaaatttaaaagtgggttatccgcaaaaattttggccaaaatggttctccatgagtctagcaacaattttagaaggaataggatatgtttttagatttgaccctccactttctagaagagatgttaaatggatgactacaaattactgggtatgtgattgtacaaaagcaaaaagagactttgggtataatcctaaaattacattagaagatggagtaagaatgaccatagagtgggcacaaaaaaaaggagtgttatagaaggagtaatatcatgatgcataagtttgtaaataaaaaagaaatgataggtagtaaagagatagcatataagcttattgagaactgtgaagaatggccaaattttataaaggaatgcttaaaagtgaatattattgaaagaaatgataattcatatttaaggtatatggagagcaaagtaaatggaaagttagtttctatgaagacttgttgcgagttttttccaggagaatataagatgaaatttagacaggtaaaaagcccctggcctattaaatcaaatgctggagaatggtatgtttaccaaattgaagatggaaaattagagatggtacttagtcattgtattgaagcaaagtacggatgccttggagattttattataaagcttattataggaaaacagtttgttcataatcatgctgaattagtattaaatgaatttaaaaagaagattgaaaatatgagctaaaaaattatttgaaaggagaaaaagtcctatgtattatactgaaagcaatattatgatttgtgcagattcagcaaaagtttatagcatgataaaagatacatgtaaatggccacaaattttcccaccttgtaaatctgtaaagattttaaagcaagaaggaaagagaattgaactagagttaacagcagtaacacgtaaaaaagagttttcatggaagtcagaaaggatttttgatgatgaaaataaaactgtattttttagacagcttgaaccagctaaaccgctaaagtttatgactggaaaatgggttgtggaagaaaagaatggcaagacacaagtaaaattaactcacgagtttgatgtaaatgttaaatattttaaaagattattttctctatttgcaagagtttttttattgatacaaatagtgaaagagaacttaagggcttaaagctccatgtagagagtaattaattttatgggaaggggaagaagaataatgaattttaaacataaatattttattaatgcaaaagtggaagaagtatatgaaaaactctttcaaattgaaaaatggcctgatttaattccacatgtaacagagatacaaccattaaatattgatgataaagaacaaagagttataatgacaatacaaaatcaaaaaggtatagaacaaatggagactgtgagaacgtttgttaaagataaatatattacatttcatcagccaagtccacctaagccactatcaatacataatgggaagtggaatttgcaagaatttgatggtggtacaatagttgaatcagtgcatgaaattaagagttatatgccgtttatgggtaaaataataccttatattgcatggaatttatttattaagaaaaatagtattctcacgttaagatcgataaaattggatttagagtttggcaaatcctcaataaatagaataataaaggattcatgttttataaagcattctattgatgtcaatcttactattgatgaagcttttaatacaattggaaatcctgaactttggcctattctttttcctacagctattaacgtaaacgtattaaaacgtgaaatcgctttaatagaatttgaattaaatgaatatgtgggtaaaaaggtattcttttcccatatacactttcatttagatagggttaatcattgcatatattatcagcattatccaccaagttttccagttaagtatatggtaatacgatggatatttgaagaattagaaaacaatagatgccgtttcacaatactacgagaatataattttaatataccaattataggtaaagtcgttgcgtatactatgggaagaagaattattaaaaaacatgttgatgattattttaatgatttacgaatatttgttaaaagtctaagtgtatgtaaatggtttgaagaaaaaaatttccctataagcaataggaggagaaaaattatatataaaccagattaaattctttattggccaaaatggtatgaattccattcatgccacaattatatgtggaggtaattaatatgaaaaaaaatcgcgttgtgattacgggtgttggggttgtatcacctttagggatttctacggaagagtggtggaagaatcttttaaaaggacagagtaaagttgattatattgattttggagaaatatcaacaataaaagcaatgggagctgaaattaaagattttcatttcaataagctttttaatgaagctgagcgttatgaaaaatatttagataaaggaatgaaatttgggtttgtagctgcagatgaagcttataaagattcaaatttagaatctgcaagagaacttatttcaaacgatagatttggagtttatatagggacaactactgctggaattgtatcagcttataatgaagggacggaattcattagaacaaaagattataaatctgttaatccagaacttatatattcatttccaccagcagcatggcctgcactactagctaattattttagagcagatggaatattacgttctatgggtacaagctgctatgctggaggggaatctataggcaattgctatagggatattagagatggatatatagatgtagcagttgctggtggacttgatgcaccaataataataaccaattatctaagtttttaccttattggtgcaacttcaagatggacagggaatccatcagaagcttgcaggcctttttctagagacagaaaaggtatggtatttggagaaggagcagcatttttcattattgaaaatttggagttagcactaaagagaaatgctaaaatttatgcagaagttgttggatatgctgctactactgatggagatcatatggttcatccttcagagactggttcaagatgggctgatgctataaaaatggctatgaacgaagcagagatttctcaagatgatgttgattatgtaagttgtcatgggacaggaactcgggctaatgatcgtgcagagactagagcaataaaagaagcacttggcaagcattcaaaagaaattagcattggaggaattaaatctatgacagggcatgcttttggaggagcaacggcaattgaagttgctcaactagtaaagagtttagaaacaaaagttgtacctcctacgattaactatagtgaatttgatccagaatgtgatcttgactgtgttcctaatgaagcaaaaaaactttcaaaatgcgattgtgtgctgaaaactgcagcaggttttggcggttctaatatggctatggtgttaaagaaatgggaagggagataaaaatatgattaagaacgttattactggatttggtatattcacacccaaaagcaataagcctgatatattatggagacatcttctaaataaagaagatctatttgatgttgtagaaatagatgataaaatgcaaattaaacaaggaaaagcaccaatatttaaggtggaagaatatggcattcaaaaaaagattttaagatatattgataagcaggtactttatagtgttggggcagcaatagaaaatgttaaagcaagtaaactagaagaacagctaaaaattgaaaatgttagtaaaagaaccggaatagtaatgggctcaatgtttgctcaaatggattttggtttagagcagataggagtaactggagtagaaaattctacaagaatttctccatatacgggtgtggctttctattatggtgcaagtgtaggtgaagtttcggttaagttaaagacgaaaggagaaaattgtgcagtattatctggtacaaatactggaatagatgcactaaatatagcttgcaatatgcttgataaaaagacaaatgatattgttttagcaggaggtggggaaaatgttgtattagagctttttttaaatggattaaacttaactaaaaagatatcaaaaacgtcttatagaccatttgatacgagaagagatggttcatttatttcaaatggagctggagttgtaacagtagaaacagataaaaatgctaaagagagaggttgtgaaatctatggagaaattgcttcaattcatacgataaatgcttcaagctgtttatttgaacttaatgaacaaattgtagattatacttatgaggtaataaataggtgtcttgaggatgttggaataaagccggaagaaatagatcttgttgtaccaactgcagatggtacaaaagacggagattactatgaaatgatggcactaaaaaaagtatttgggggaagaaataagattatttatacaccgaaaccaattgtcggctactgtatgagttttaatagcattattgatatttttgttggagcaatgtcaattaagcatagccttattccaggacatcctgaaaagtatgattcaggagatgaagaatttaatgaaatgcttgtaggaactgaacctgtgaaacgtgatgtaaaaaatgttttgttgcttcataggagctggatagatggaaaagtaagtgctctacttttaagaaagtatatagcgtaatgaatgaaaatatgttaacaaaaattattgacttaagtgtagagatagaagatggaagtgtgtctgaagaggtaatgcccaaaattaactatattaatcataagaagggagctgtttatttaggacttggattgttatggaagggagacaattttataaaaaaaatatggaatacacttacatgtatttttagcggaagagttctcacaccaaaagattttaaggataatataggactctcaacagaattgataaaattatctacacatactggcacacatgtggatgctccataccactatggtccacaaaacaaagatatatcttctttaccattagaaatattttttaatgatgcagtggtgctggattttagtactagaaattctgaacttagtatatctaaaaaagagattacgcgaaagcttaaagatattgaatatacacttaaaagaaatgatattgttattctccggactggagcagataagtattggggaacaaaatattacacagtaaaatatgtaggtctttctgtagagggattagactttttattagactctggtgttcaagtaataggaacagattgctttggattagatcagccctttcagtggatgcacaaaaagtatatagaaagtaaagataataattatttgtggccaacacatatacatgggcgtgaaagaccttattttatgattgaaaagatggcaaatttagaaaaactagataaacaatttggatttaaggtggctgcattcccaataaaaataaagaatgcaagcgcggcctggtcacgagtggttgcaatttttgaaaaataagaacattttaaggagatgatttataatggacaataaaatattcatgaatgaggtagtctgtaatggtaagaagcgaaatgcatttttgttctattttcttactataggtgagatggctgctattgcaatattttactatttttttgacagggcttttaagtattctcaaattgctggacaggccgtattgcttgcaattacagtgacagttttaggtcagttctatgtaaacaagaaaaaatatattaagaaatatggagttgaagaagcttatagaaaggctttttttagatttcatgtaacaactatgccatttatttatgtatcggctatacatccaatatatgcttattcacaaagccctgcatttattaatattcatcttagagtaataattgcagcatatttcattatatcagcggttattttacacaggcgtacaataaaaatatttggagtagataatctttttatgtactatgtatatttgccagagaaaagtgtaaaaacagaatcgactattcactcaattattagacatcctgtttattcagcaatggctagaacttcaataggatttggaattttaggtggaactcctgaaagtgttattgttggaattattcttccaatttctcaattattctggctttcaatttttgaagaaaaagaattagtacaaagatttggaaaaggatattcagactataaaaaaagtgtttgggcagtttgggtaaagcctaaaaatttaggaggatttcttaatttcttattggggttaagcaaataatatagtatttattatactaattaaggggctgtcgcactaaaaatagtgtgccagccctttttaggtgaaaaaataaatctcaaactcctaagagtttgagatttatggtaaaatgaacttatgcaaaaaagaaacattttacaaaaagattatacaattaatcagaagttttatcaattaaaacttccattaaatattgattatatgattgctactaatgattcagtgcgtttactaagtcaatttattgaggagatggatttagcagatttatattcgacttattcccgaataagggaaaatcaagtatcgccaagaacattactaaagatcatgatttatggatatatgaatagattatattcatcacgagatattgaaaatgcatgtctaagagatattaactttatgttcttacttgaaggggcatccgctccggatcattcaacttttgcaagatttagaagtcttcattttgcaccatgtgctgaaaaaattttagcaggaatgactaattttctttatgatattggtgaaatatctggagaatctatttttattgatggtacaaaaattgaagcgtatgcaaataaatatactttcatctggaaaaagtcagtcacaaaaaatatggcaaaattattggataagatagccgcccttgtccaagaatgtgaagaactctatggtataaaactgatttataaaaatactgtccagatgaaacatgtaaaaaagcttagaaagagactctatgctataaaaaaatcagagtcaatagactttgtccatgtttgtggaagaagaaaaaatccgctacaaaaatcaatcgaaaaacttgaagaatatctttctaaattcaaggaatacaatcaaaaagtatacacttgcggtagtagaaatagttattccaaaactgatgttgatgctacatttatgagaatgaaagaggatgccatgaaaaatggtcagcttaaacctgcttataatatacaacatggtgttgatgctgaatatattgcttggcttactgttggcccacaaccgacagatacaactagactaatacctttccttaaaaatatggaagaacacttgaattttaaatacttaaaaattgtagctgatgctggatatgaaagtgaagaaaattattcatttattgaggttaataatcagatatcattcattaagccagctaattatgaaatatcaaaaacaagaaaatataaaaatgatattggtaagatagaaaatatggattatgatgctgaaaatgatttatatatctgccaaaatagaaaaaagctaaaattggaaggcatcaaaattaaaaaatctaaaaatggatatcaaagcgaaaaatcaatttatatttgtgaagattgtagtaattgtacatataagagtaaatgcattaagggaaataattctaaaattcctttagagcaaagaactaaaaaatttgaaacttcaaaaaaattcaataatcaaagaaaagaagatttagagagaattataagcgatgaaggttgtcagcttagaatgaatagaagtattcaagctgagggttcttttgctcaagtaaagcaagatatgaattttaggagatttatgtgtcgaggtcaaaagaatgtaatagctgaaagtatcttacttgcgatggctcaaaatataaacaaattgcataataaaatctaaaagaactgaactggtaagcatttatttgaactgaagaaaattgcataatttaaattaaaaaagtcttttttataggctttattaaagtgcgtccttttttagaaatataaattttttaataatacttttctgaaaaaataagaaaaagagctatcgctaacgggtttttaaacccgctgatgcgacagcccctatatcaataaattgagtttttttttcatattattttattttcttaaaatttcatttatatcataaagtaacttcttaagatagtttttcattatattgaataagtagatttattttactctaaagttgtagttttcagcaataaaagcttatattttaattttttaaagtattatctattaaacattcttataacaaaaagggatatccttatgataatgctccaatggaatcctttcattcctgctttaaaaaggaagatgagaaaatgaataaatactttgactttaacgatgcaaagctatcaacttttgaatatatttaaagctgatataataggagaagaattcatagtagaattggatatatgactccacaagattatgaagatcttattctaaaatctgcttaaaaaactaaaaaaatgtgtctactatattgacataagtccagtaggtgagtagtttaatagacaatcaaacgattctttgatattctttattagaaatgttttttttatttcttacaaagttcaaatttctttattacaggaagacttaattagtaattagatttttagttatattaagtcttccattatattcactaacttatttactcctccaagatttaataactgatttcctacttttttggaattttttgaatatgtgggatttttgctgaaattattaactaaattaataattttttcagcattaaattcatttgcttcgagagaaactcctgctgataaattaactattgaggctgcattatatcttcgttcaaaaacattacccggacatatgatttgaggaactccatagattaaccccgtcataatactattttgacctccatgatttatgtatgctatagtttcaggcataagctcattaaaatcaaatcttttattaacagtaatattatcctttctatatggctttacttgatgtgttgcaatatatacttgaaaagcagtttgtttaaatgatttgtttaaagtatttataactttattgggagtaattgttccatttcccatatacactaaaactttatttctatgaggtttaattttattttcactaaaagtagaaaatggacctgtaaaaactatgtttttatcatcaattggctctaattcatatgaacttggaactacctttaaatcagcccaattaaatatatcaagaacagattctattggcggtaaattattttcttgcaaaaattccttaatccctatactgtattcaggattagaggcaaaagatttttgaacgggataactatatccagtaataactttaatattttcaagctttgaagcaacaattgcagaaagtctaaattcagcatatactagatcaggcttaaaatcttgtattgcttttcttatataaaatacatcttcataaaaatgttttttatttagagctccaacaagatgaagcacttcttcgaaactattaacttttcttttttgctgaacaccaaaaaactgtgcaattttaaatagattttttcctataaacatgggcatttctaaaggggagggaatgggggcataataattttttacattttctatacttctatagttaatatcttctgctgcgcaaagtgcaacttcatgatttctctcaagcaacttatgagataaagtaattactcttgaaaaagtaccatttgtttctgccattgcagacataggtaaaattaaaactctcatagtatcatcaccctttaactattatttttaattaataatactttataaatgtttaacaacgtataatttcttttatatgaaaattataacattaatttttagagtatggcaggtataaactaaattgctataaaactaagaaagagtattatagcaatttagtttacaattgtttattttaagggaatttgaacatcagcagacattccagattttattagtccttcttcgtcacttacagcaacttttaccttggtaactgaatgtttactatcagaggttgattgtttatctttaggtatatattcatgttttaaagcaatataattaacagtaccagtcaaagttctatttgatgttattacatttaatgattgatcataagaaactttatctaaatattcatctggtatatagaatagaatgtatgtatcctttgaaacagctatatctgcaatgttactacctatatttactgtatctcctaattcaaaatttttacttattatgattccattatctaaagctgtaatattacagttatttaaagtgttttcagcttgatttaactgggcagtagcttgatctaaatcagcttgagcagcatcaatagtttgtttggtagctccactttttagtaaatttaattgagcatttgcagcatcataatttgcttttgcagtatcaatagcttgtgatgttgaaccatcctgcagcaaacttaattgctgtttagcgctttctagagtgtatttagcagaagaaagctgatcagtggttgtatctaattttaattttgcatcatccagagtacttttaggtactgctccagtttcatatagtttagaggtttggttatattgattatttacatagtcatatgttgattgtacagaatttacagtatcttcattaatagaaactgtatttttagcttgttctatttgttcgattctgtttccagaagttaaaaggtctacttgagctttagcagcacgaacctgtgcttctgcctgttgtatttgttcaggtcgagttcctgcttgcaattcttcaagtttggccttttttgcatttacaacagctttcgtttgatcaacaacgtatttttgatttgtattgtctattacagcaataatatctccttttttaacagtttcaccttgctttttattcatttctataattttaccagaaacagtgctagtagctggcagaatgttgttttcaacatctccttttaacgttaatatatttgaatttgaagaacaaccagtaattataaaggaactaagtaaactaatactaagatgtataaagaattttttcatataatcactccttgaaatgtatttttgaaatttagtaaagttttttataaattttatatataattcatttatttatatttaagaagtaatatctgggcaaaatgaattggtaatatattgaattaaatagtctatatctttttcgctatgatctaattcaggtaaagctatataatgtataaaaagatatccaaagatagaagtagttattatattaaaaatagaagcgcttggcatatcaataatctgacctttttgtttaaacttatcaataatagaaattatttttcgtgttgaaggaaatataattgtatttaaaattttacttctaagttcaggatgaaaaggtatttcttgaattattacttttaaaatagatgaactttgtaatacaaaattttttctatttatcaatatctttcttagaaagttatcaaaactattatggttgtaatttaaaatctcgtttaaatcatcaagaaaaatttcaatgaaggaagctttagagagagcagagggaatagaaaataaaaggtcttttttagttttataatagttaaaaatagttccttccgctacttgagctcttttagcaatttcactagtagttgtcgcttcataacctttttcagagaaaagttctatagctgcactaagtatatttatttgcttttgggtcatactgcaatctatattgtttagatttataaattctttcaatgattttgttgatgtcaattttatcacctcttattttcgctatattttacgatatttttttagagccaatatattagctgctgtaaaaaatatacaaattaatattagaattaaggcatcaaactttatatcactcaatccttttcctcgcagcataatacgtctaagagcatcagctgaataccataaaggcataaagtgtccaagggattgtaggaaaggaggcatagtggttatctcaaaaagacctgaaaaaaatacttgtggcactataactattggaatgaactgtattatttgcaattcgttatttgcaaatgcagatataaatgttccaatagtaagggcagccattgcagttaatatagttattaaaagtactaaagaaaatgaacctatcatcataatattaagaacattaatcgaataccatgcaataagtgcagattgtattatagtaaaagctccaaagccaagaagataacctataacaatttcccagcggcggataggggtagcaagaattctctcaagagtaccggtagtacgctctttaagaaacgctattccagctataagaaacacaaaaaagaatacaaaaaatccaataagtataggaccaaagttatcaaaatcagccatatcatcataaccatataaataagttatatcagtttttacattttgatttaattgcaaaagagcatttttggtgatattgataacaaccttgcttctatttggattacttccttccaatgttattttaggaactccattttcaaaattgattattgcatcaatttctgaagcttcaagtattttataaccattgttttcagtgtatctaatgacttttacatcgttatcttctaatttatttacaaaattaattggtgcattaattattcctattttaggatgatagtcagaaccattgaatataatggacattagagttaaaacaagtattggtgataaaatcattaatccaatagtacgtttatcatgaacaagttgaagtaagattctaaccataactgcttttactttcatttagattcacctccaaagtataaaaaggcttcttcgattgtacttgaatttgcagcttgtttaatttcagaaggagaacctagagcaattaattttccgtcacgaatcattccaagtctatcacatttttcaacctcatccattacatgtgtagtaataatgattgtagtaccattctctttaagtttattcaattcttcccatattgatttacgaagaactggatcaataccaacagtaggttcatctaatattaaaacaggtggttcatggataagtgcaattgcaagggataaacgtcgcttcataccaccagaatattgctttacctgcttttttaagtgatctgatagattaacaagttccataacttcagtaattctttgtttttgtttaggttttgaaagttcatacatggaagaaaaaaatttaatattttcttcagcagtaagttcatcatatagagcatctgattgtgccatatatcctattttattcatcatcaaaagttttggcattttttcattaagtaaatatacttcaccactcgtaggaatatcaattccagaaaacatttttacaagggttgatttaccagatcctgatggaccaagcagacctaatatttgagaataaggtacatttaaagaaatatcaaaaagtacctgttttttcccaaaaaacctgctgacatgctcaattcttatacaaggagaattttgtaaagtgttatcgatagtgtctttcataatattgctcctttcaaaaataaaaatataaaaaagtgtgattaatcactcatttgtaatatgtaattgattaaagcttctttaataactactcatctatgtgcaattaaatattctcataataccttagggaaataaatagattctcctccaaacagatgaaataatgcggaaaaagcaaataaattacttacctgattaatttttataaaatattctgtttaagcttataaatgtacgtttaatgatatttgtattgactttttactaagtaagtagtaactaaaacgaaataaataagaagtgaaaagtgagttcaacgctttatgagagaaatgaatctatatgcttttactgtaaaaaaatgaaagcataaatcatcgtgaaaaattaaatataattcaatcatttagtaagaaaggatgtgcttatgataatgcctgtatagaatcagttcattctagtttagaagaagtatatacaactacatataaagactttaaagaagcataattggatatatttgcatatatagaaggatggtatagcaggaaaagaatacattctgctataaattatatgactccaagtcaatgggaagcgttagcaaggaatgttacataaaatttcgattttttctgtctactatattgacataaatccaaaatatatcaaagcaataagatagaaattatttggagatgttagatagtaggctgctgcgaaaagaatgaaaattaaaatatatgtagtagattgctaaactctaatacaacacattttagctgagtttccaaatgctatagtacttttgtaattaaaaagaaataatttaatagaattataatatatcaattataatttaaggttaaatgtatgaatgataatatagaaatagtatatggaaaagaagatttcttcaaactgtttgaattattggtagatgataaaattcaagagatagtccaaaaggctaaacaggatagtaaaacgtggtataatgataaggaatactatccatccacaagcactaacagtgaggtggatgaaaaagatgaataaaatatggaacattgcaatttatgcaagagtttctacagataaaaaggaacaaagtgaatctattccggtacaggttgaaaatttaaaaaaatggatattgaataaatcaagagaagatgtaagtgcaatatacaacttaattgatgtctatcaggatcaaggaacatcaggatcttcatttgacagagaatcttttattagaatgaaagaagatatagaaaataagaaaattaatatgatagtaactagagatttatcaagattttcaagaaattatattcttgcaggatattatttagaggattactttaaagtaaataatattagatttatatctgttttagataatgtagataccgaatcagaatttgataatgatattatacctttcaaaaatattttaaatgaaatgtatataaaggattgtagcaggaaagttagatctgcattactaacaagaatggaaagaggaagtagtattgctagcaaaccaccgtatgggtataaattccaggaagtttatgaaggaaatcaaaaaaatataaaattaatttccgctgaagatgaaagtactcaggttgtgagagaaatctttacattatacttatcaggatggggagcaggaaaaatagcaagttttctaaataaacaaggaattgaaccaccttctaatagaatcaaaaactttgctaggaaaaaatttgggaaatggagtaataatactattataagtatattgagaaatcctaaatatggtggatacatgattcagggaaaatataagaaggtaagttataaggtcaaaaaaattaatataatgcctgatgaacagtgtatatatggaggagaatttgaaggtataatttctaaagatgtttttgaaagaactcaacaaatgatgaaagatcgctctaatagtaactatagatataaaaatggagttgtacatgctttttctggagttcttaaatgtggaaaatgtggagggagtatgacatatagaaaaaaatataagggatataagtgtacgaatagtcaacaaggtgctcaaaggtgttctccacacagtgttaaagaaacaagactaattgagattatttcaaatgaaataaaaagcatgatagatgaaaaaatagataaaagtaaggtatatgatagattcaataatataaaaatagaaaatgattttgagaatgaattaaaatctgtagaaaaaaaattaaatgctcttgatggtaaatttaaaaaaatatatgaagataaattagaaggtgttgtaaatcaaaggaattttgattttatgcttcaggatattcaagaaaaacaagataaacttatagaaagaaaaaatcaattagtaaatatgcttaagaaaaatgatgttgataatgacttgttgaaaaaatataagatagaaatagatgatctactagaaggaaaaacaattgataggagattagtagaaactctaataggtaaaattattgtagatgaggttaatgaaagtaaagaaaaaaaactaactatatattataaattttctaaataactaagcatagatattgaaattataaagaagtgtttttgtaaaaagatacgtatcgtctaaaaagggactgctacgtgtataggtttatctgcggtgaagcttttaaagcaggatgctgatgctgttatggtagttcttccttcagaccattatattcaaggtgagaaagtttatacagacaccttgtctcaagctattgagcttgctaatagaagaagatgtgttgtgacattaggaattgaaccaagcagacctgaaactggatatggttatattgaaatgggcgaaagaaccactggtaatataccaacttataaaatagctcggtttacagaaaaacctaatttagaagtggcaaaagactttatattgaagggaacttatttatggaattctggcatgtttatatttagagcagatgttatactacgagaaatagaaaagtatttgcctaaattgtataagccattaatggagatatataagaatttaggagaagaaaacgaagaagaggttatcaaagagcaataccaacttattgatgggatatcaattgactttggagtaatgcagaaaacaagaaaagcatttgtcataaagggtgattttcaatgggatgatatgggcagttttggggcattaagcaggctccttcaaaaagataaaaacaacagtatatcaaagaatgtgtatattgatgaatgtgaaaattgctcaatattcggaaataaaaatttaattatcggatttggaataaaagacctggtagttgttgacgctggggatgtaatacttgttatggataaaaacaaagatcaagaaattaaacatctattgaataaactgagtcaagaaaatgagtttaataagtttttataagagtaaaaataataatctatgtgaaattaaaaactaatttcgcatagattattgcatgtctagctcttcagatgtactcgatacttaaatttatcagctctagctatgcttatggtatactcaattacggtatcattatcataagtaattctctcgatttttagagctggatttccttgaggaatggacaaataaataccttcaagtttatttatcaatatactttctaaaatttcctcagcagaagatatttttattttaaaattattttttaatacttcatacataggattttcacctaaaagctctctagttaatccttcaaatctatcatagggaaggtaggatatttcatagatatgtggaatatcatcagcgagtctgagtctaataattttaaaaactagagagtctttttttagatttaatttattcattattttgtggtcaggttcaattatttcaaatgctaataatttagaagctggttttttaccaagtttcttcatttcgtctgtaaaagaagaaacttttattaaatcttgtgccactattttaggtgctataaagtttccctttccttgaactttataaatatatttctttttttctaattcatctaatgcctgtcttacggtagttctgcttacatcatatttttggcatatctctctttctgaatctaactgatcatcttcatgcatgaaatgttctattttataaataattatattcattaattgaatatacaatggaattttcgattctttatcgattgtgttcacaaaaggcacctctttcaaactaatctaattaattatagtattagattgcaaaaaaaatcaatttaaatagtaaatttagatacgttctaatgagcaccatatgtaaatttactataatcattctaaatttctttacgttaacatttaagttcatagttacactttatctgagtttagaagataaagtggtaattaccaaagagagtttatattcagcaaaaacataattagaaattttaatattaatagttagctgtcgtatattaatgtaatattagtaataaagcacactctgtgataattctaactaaataaatagtatacattattcaagtatctccaaattaaatttataaatacttgaaaagatatttataattaatatataatgaattatataagtggtaattaccagttgtgaaaagatattaattagggaaggtgaaaatatgattattaaaaattgtaaaattatatattgggatagaatagaagaaggaagtttattaatagaagaaggaaagataaaagaaattaaccctaaagaatgtgaagatatggatgtaatagacgctggtgggttatatgtttctccgggatttattgatgttcatatacatggtgcaggaaattgcgatactatggatgggacagttgaatctataaatactattgcagaaactatagtaaagcatggaacaacatcatttacaccaactacaatgactgcatcagtttctgatactagaaaagcattaaaggtaatacaattgtgtaaaaatactggaactagaggtgcaaatgttttgggagcacatttagaaggtccatttatcaataaggatgctatgggagcacaaaatggaaaatatattttagaaccaggtgttgacaaatataaagaaataacagatggatatgaagatgcaatagtttcaataacaatttcgccagaagttgatggagcagaagatttagtaaaatatatatcaaaaacaggagttgtatgttctactggacacacaaaagcaacatatgaacagactattgatcatataaaatggggagtatctcatgcaacacatttttataatgcaatgactccgtttaaccatagagaacctggtgttgttggtgcagtatttaatacagatattacagcagaattaattagtgatggaatacatgtatcttatccagcgctaaaagttgcatataaggaaaagggatcagataaattattattagtaacagatgcaatgagagcgtgctgtatgaaagaaggaatgtatactcttggaggacaggatgttgtagtaaaaggaagttcagcaagattaaaaaatggagttctagctggatctatacttacattagataaagctgttaaaaatatatataagaatttaaatgtacctttatttgaagttattaaaatggcatcatataatcctgcagtacattgcaatgtacaaaatagaaaaggtataataaaagaaggttatgatgcagatttaatattatttgatgatgatattaatataaaaaggtttttgttttaggtagagaagtttaataatatttagaattaatttttatatagctatttttgaaataaatttatgaggatgtagtgtaaaaatatgaaaaaagaagagcagattatagaagttttgataaatcttgaacgaaaatataatagaggtgttagtgccttagaattaggttcatacatgaaaatggatagggctaatgtaagccgtcatctaaataatttgagtaaagcaggaaaaataattaaattaaatgggagacctgtattatataccactatcataagaaaaaatgaagaaaatcaaattatagcaaaagatattgattctgataactctacatttaaattagaaaaaagcaaagatagcttggaaaaactagtaggagcagaaatgtctttaaaaatgcctatacagcaagctaaagctgcaattttatatcctcctaggggacttcatacattaatacttggggaaacaggtgtaggaaaatcattgtttgcagaaatgatgtataatttcgcgaaagaatctaaatcaataaatgaagatgcaccttttgtaagatttaattgtgctgattatgcagataatccgcagctagttgttgctcagatatttggagttaaaaaaggagcttttactggggctgataaagataaggatggacttttgaaaaaagcagatggaggaatcttgtttttagatgaagtccataggctatcaccccaaggacaggagatgctatttacattcattgataatggcacatttagaaaactaggagatactgatactcaaattaaagcatcagtccagataatatcagctacaacagaagatatacaatctttcatgcttaaaacttttacgagaagaattccaatgacaataactttaccgcctcttagacaaagaactttggaagaacgatatttgttacttgaatcatttattcgagaggaatctgtaagattgcaaaaaaaaatatatatcagcaaaaattcaataatctcgtttttgatatatgactgtaataataatatcggagagcttagaagtgatgttcagctagcttgtgctaaggcatttttaaattataaagtaaataaaaatgactttatattaatagaccaagacgagttgcagcctagggtgcaaaaaggaatgatgaattttaaagcctatagaaatgaagttgagaaaatatcatctagtattagtgatattgtacagttttcatatgatgttgaaagtaattcagcattaaagatactccagaataattcaaaagaaatagctaaagtaagtttttattctatgatagaagataagatgaatgagctaaaagaacagaatatagatccagatgaaataaataatattttaaatgtagatttagaaaattattttaaaaagtatataaatagtctaagtgatgaagttggaaaaaatgaaatatcaaaaattgttgatataaagttaatagattcagtagagcaaatgctgaaaattgcatctgaaaaattagatagacagtttgatagaaaagtatattttggattatcattacatttacaaggtagtattgaaagaatgagtcgaggaatcaagatacaccatccaaagcttaatagtattagaatgcagtatagagatgaatttataacagcaatggagattattaagataatagaaactaactttaatgtacaggcgagcttagatgagataggttatataactatgtttttagcagctggaaaagatgaatttaatgagttattagaaataaaagttggcgttttagttataatgcatggaaaaaatactgcctctagtatggttgaagtggcaaataccttaattggagaagaatatgtaaaagcattagatatgccgttaacaatgaaagctgaagatatgcttgaacttgcaaagaagaaaattttaaatatggaaaatcgaaatggtattttaatgcttgtagatatggggtctttaagtaattttggaaaaataattgaaaatgagcttggaataaaaattaaaactattaatatggtaacaactcttactgttatagaagcggggcgaaaggctttaaatggtagaagtttagagtcaatatatacttcttgccaggagcttggaagattttcaatacaaatggaaaaggaagattatttaaaggaaaaagaattagccataataacaacttgctttacaggggaaggtgcagctgaaaaaataaaaaatagaatagaaaattcattaaaacacatagataaattagagataatacctttagatattttagataaagaagattttttcaaaaaagttaaaaaactaaaagaacgatatacaattttagctattgttggaacagtaaatatgtttattgatggagttccattcatatcagcacaagaaatttttattgataagggaattgtacgtttagaaaatttaataaatattgaagatgagtttttaaaagtaacagaatcattagaatcacagattaaaggtttaaattgcaggaagatggctattaatataagagatactatttcaaatattgaagaaagcttagagattaatatagatcaacaggctaaaataggtattttgattcatatggcatttttaatagagagattaattgaagaaaatgaagaaattaaatttaaaaacttagataaatatagatatgaacatggaagagaatttattttagtgaaaaagagtttgagtaaaatagaaaacgaatacaagattattattaatgatcatgaattagcacacattgttaggatggttatagaaaataagataagcgtgtaaattataacaagtaagtgtgtaaaaaatatagtgtgtaagtagaaaatacacactatatttttttcattacacagtagtttatagaacgtaaaacaagtgatagagccaattacataaaattaaaaaataagttttagacttggcataattattgctttatatataagtgtaataaaagtacaggaggaatgataatatgaaaaaaatattattagtatgttcagcaggaatgtcaacaagtttattagtatcaaaaatgcaacaagcagctaaagataaaaacatcgaatgttcaattagtgccacaggggaatcagaattaaaagaaaatatggatggaacaaatgtaatattattaggaccacaagtaagatttttattatcaaaaattaaaaagcttgtagaaccaaatggaatagaagtagatgtaataaattcagttaattatggaacaatgaatggagaattagtattaaaacaagcattagatcttattaaataattaaatttgaaaaaattataacaacatacggagtatattaaggagaataaagatggaagaaataataatgaatctaatattacacagcggagaagtaagaagctattcaatggaagctattcaagaagcaaaacgaggaaatatagaagaagctagaaaattaattgaaaaggcagataaggaacttgcagaatctcataaggttcaaacttcattgattcaaaatgaagcagcagggaagaaaacagaagtttcattgttattagttcatgcacaagatcatttaatgacaagtatgactgtaaaggatttagctatagaaataatagacatacatgaaaaaattaaataatagtaattttaaataaagaaagcaggggaactatgaaatatgttataggagtcgatgcaggtggtacaaagactgaagcaatagcatatgacggtaatggaaaaattattgcaagatctgtaaaggggtttggaaatttattaaatgataaagaagttgcattatctaatatagaaagtgctgtaatagaaataatgtctacatgtggaagagaaaatttacatggcatatatgtaggagcagctggatgcgaagttggagataatgcaaggcttatagaagaaagattgaaattgaagatcaatacttatataaaagttatgaatgatgcagaaattgcattgaaggctatgctgaaaggcagtgatggaattttaacaatagcaggaactggatcaattgtatttggaatgaacaaagggatttcttcaagatgtggtggatggggaaatctcttaggagatgaaggtagtggatatcagatagttatttctgctataaaaagaatgataaaagaagaggaagaagatttgccacaatcagatttaacaaaagctatcttaaaagaattgaaaattaattcagttaataaaattactgagtttgtttattcaggaacaaaagatgaaatagcctcattaacacctataattgctagggttgcaaaagatggagatataatagcagaggaaattttattagaacaaggaacagaattagctagaacagttgaaagattatataaaaaattaaaatttagtaattgttcaataggacttgttggtggggttattagaaacatagatttgcttaaaaatgcatttgaaggatatttaaaggacaacattaaagtggatgaatttatatatgaagaagtttcgccaacaaaaggagcatattatgagtatattaatgaacttaaaatagatgaggtgaattaagatgaaaagattgggaatttccgtatatccaaatcatatggacttagatgaaatagttaactatatacatttagcaggaaaatatggatttaaaagaatatttacatgtttaatatctgcaggagataaggatatagacagtgtaatagatgaatttaaaataatgcttaatgcagcaaaacaagaagacatggaagttattgcagatatagatccaactatatttaagaagttaggtgctacaatatatgatttgagcatatttaaaaaaattggtctagatggaatcagattagatttaggatttagcggacaagaagaagctataatgtcttttaacgattatggattaaaagttgagttaaatataagtaatggtacaaaatatattgataatattttatcttataaggctaatttgaataatatatatggttgtcataatttttatccacataaatatacaggattatcatatgagcattttataaagtgttcaaaacaatttaaagaattaggagtaaatgttgctgcttttgtaaactctcaagctgctcaatatggaccttggccagtatcagagggcttatgtacattggaaatgcacagaaacttaccaattgatgttcaagctaaacatttaattgctacaagctatgtagacgatattatagtagctaattgctttgcaacagaagaagaacttaaatcattaagtgaattaaataaagaaaaattaacatttacggttgaatttaatgaatttgcaagagacttagataagaagattgtattagaagaatatcattataataggggtgatgtttcggaatatatgataaggtctacacaaagtagagtaaaatataagaatgaaagttttccaccagtaaatacacctgatatacagaaaggcgatatattaatcgattcagatttatatactagatatgctggagaactacaaatagcattaaaagaaatgaaaaatgaaggtaaaactaatgtaataggaaagatagttgacgatgaaaagtttttattagattttattgaaccttggagtagctttggatttatagagaagaagtagatatattaatttgaaataaaggggagaaaaatatgaaaaagttttttgaatggatggaaaaatattttgttccagtagcatcaaaaataggatctcaaaggcatttggtagcaatacgtgatggatttgcaacattaacaccagttataatggcaggggcttttgcaacattattcaataatttagggtttaaaccatatcaaaattttatggactggttattaccagcaggatggaaaaattttggtggagatatatggaatgcatcttttgggataatgtcaatattagttgtatttagtgtttcctatcatttagctagatcttacaataaagatggtttagcagcaggtatagtagcatcagcagcagctatgatgttatataaaacatcggaagatggaacattaccatttacattcttaggagcacaaggattatttattgcacttattgtagctataattacaacagaaatatttgtcaaattgattggtaatcctaaactagtaataaaaatgcctgatggtgttccaccagcagtagcaaaatcttttgcagcattaataccatcaatagtagttttagcagtagcagcaggtgccaaagaattattaatagtattaggtttaccagatgtacatcaatcgttatttaatgcaatacaagcaccacttcaaggattagctggaagcttaggtggagtattggttatagtatttatgatacatttgttatggttctttggattacatggttcaaatataatggcaccaataataaacgcattattattaccgttaactttagctaatacagaagcttttgctaacggccaagtaccagaaaatatattaaacagccagtttattgattcatatgtcaatcttggaggatcaggagctacaattgcattacttatagcaatatttattattggtaagaggaaaagtgcacaacaaaaggttattgctaatttaggaactgcaccaggactatttaatatcaatgagcctgtaatatttggaatgccaataatattaaatccaatttactttattccatttatattagcaccaatggtatcaacaataattgcttatacattaacatacattggatttgcacctaaagtagttgtaatggcaggatggactacaccaccagtattaggagcaatattatcaactaattcaataagaggtggaattacagcccttatatgtttagctgtaacaatattaatatatcttccatttgtaataatggcagcaaaacaagaaaatgaaggtgtaaataattaataaaaattttatcagtttttactaatttaaatattttagttaataaagaataagttttctattaaaaaataaattatataatagttgtgagccatgttaaatttagttagctatcttaatttaacatggctttttatgaagatataactatatatatccaaataaaatattacgtaattattaagaaatatatcttagtattaaaaaatatataataatattgtaaatagtttgttagagtattatcatataaaagtaaggtgttttaatccttaaagaccaagatatgaactttatttgttaaataaagggatttgaatattattaatattggaggaagtggtctaatcttgatgattaatactcacaggcttatgggtgagaatattttaaaatatgccaatagtaaaagtatttatttaattaataagaaaagatttatatggggtaatataaaaccagattgtacaccgaaatataaagttaaaaaacactattatgatgaaagtatagatatgataatagataaaataatacatttatcatctcttacattagaagaagtatattttgatatgaagcttggaagattttcagaagaacttggagtagtctgtcattttttatgtgactttttctgtgcaccacattattatagatgggaatttaagagtacaaatgcagtaaaacagcatatgatgtatgagcagaagttagctaaattatgcaagacatttaaacctacaaagataattaatacaaatatcaatagggaaaatttaaaggagtttatagaagaactccaaaagcagtatgatggaatagttaattataataatgatcttacttttgcttactatgtttgcgatagtgtaatcaatatggttctgaatcatgtatttagtaataaaaatttatcaggaaaaaatataattgagtataaaagcaaagtaataatataaaagcttggaattttggagaaactattttaaaagttatagataatttaacttttaaagtagttttttttattttaaaaagtgttgccaaattatgaaattaatcatataataaaaacaaacatatgaacagatgctcatatgttcagaggaggtaagaattttgaaagaagaaaatacaaatatagataattgttcttgtaatgtaattcatgaaaatgttgtagaaatggttaaaaatgcattaccacaagatgaagtgttatatgatcttgctgaattatttaaggcttttggtgattcaacaagagtaaaaatattatgtgcattatttgaatctgaaatgtgcgtatgtgatttatcagcaattttaggaataagccaatcagcagtatctcatcagttaagaactttaaaagcttctagattggtaaagtttaagagagtaggaaaagttgtttattattctcttgaagatgaacatataaagcatattttcaatgaaggtttcaaacatataatagaataattttaattatggaaacaaattaattatgtatcatattatgaatttatagtcagctacatataattcaagaaaggatggaggcgtatgtataaagaatttaaattgaatttaaaagggcttgattgtgccaactgtgctaataaaattgaagacagagtcaataaattagaagaagtagaagaagctaatataaatttttcattaggaagaataaatataaaaataaagaatgaagattctaaacaaaatgtaataaatcatgttaagagaatagtaaaggaattagaaccagatgtagaagtaagtgaatataagaaggtatcaaaaccattaaaaaagcctaattctaataatcatacgaatacgaataaagataatgaaataaaattaattctggaaggactcaattgtgcaaattgtgctaataaaatagaagctagagttaataatttagaaaatgtaatagaagctagtcttaatttttctgtaagcaaattattaataaaatttaatgaaaatatagaaaaagcaactataattaattcagtaaaaaaaatagtaaaagaactagagccagatgttgttgttaaagaagatgggaaagaaaaacaaattaaagatattaaaaaccatgaacatcagcattgtgatggagaatgttgcaaacatgatgaagatcaagtattagatacagaaaatgagcaaggttatgaagcaggttttttaaaaaagaattggagtttattattaggaatagtgttatatgcaactgcacttatatttgaagataaagaatatataaatttaatattatttttagtggcatatattctagttggtggaaaagttgtaatgaccgcattaagaaatataacacgaggacaggtttttgatgaaaatttcttaatgactattgcgacactaggagcttttattattggcgaatatccagaagctgttgcagtaatgattttttacgaggttggagagttgtttcaaagttatgcagttaatcgttctagaaaatcaataacatcacttatggatcttagatccgattatgcaaatttattaactgaaagtggagaaaaaagggttgatccagaagatgtaaatatagatgatattattgttgttaaaccaggtgaaagggtgcctcttgatggaatattaattgatggaatatgttctctagatacatctgctctaacaggtgagtcaattcctagagatgtacaaattaatgatgaaattttatctggaactataaatttgaattcggttataaaagtaaaagtaactaaagtatttggtgaatctacaatttcaagaattttagagatggttgaaaatgcaggtaataaaaaagctcatacagaaaaatttataacaaaattttgtaaatactatacaccaatagttgtattttcagcagttgcaattgcgataattccaccatttgttataaaggatgcaaatttttctacttggatttatagagccttgtcatttttagttgtatcatgtccatgtgcattagtagtttcagtaccccttggattattctcaggaattggaggagcatcaaggaagggtatattagttaaaggtggaaattatttagaagcccttaaagatgtagatatagttgttttagataaaacaggaacattaacaaaaggttcttttaaggttactgaagtaaatgtttataatatatcaaaagatagattaattgaaattgcagccttaggcgaaagtttttcaaatcatccaattgctcaatccatagtaaaagaatataacaaagaaattgataagagcagaataaaaaactatacagaattatcagggcatggaataaaagcagaaatagatgaagaagaagtattactaggtaattttaaattaatgaaaaaatataatatagaatgtaaggaaacacaatctgtaggtactgtagtttatgtagcaatatcagaaaaatgtgttggaagtattgtaatagaagatgctataaaagaagattcaaaagaagcagtaaaaagattaaaaaatcttggaataagaaaagttgttatgcttacaggagataataagaaagttgcagaaaaagtaggaaacgaattagagattgacgaaatttatggtgaattattaccaggagacaaagttggcaaagttgaagaattattaaataataattctaataataaattggtgtttgttggtgatggaattaatgatgcaccagtgcttgcaagggctgacattggagttgcaatgggtggaattggctcagatgcagcaattgaagctgcagatgtagttttaatgaaggattctattaattctttagcagatgcgattgttataggaagaaagactaataagatattatggcaaaatataatattttcgttagtaataaaagttggtgtactaattcttatttcttttggaatgtctagcatgtgggaagctgtttttgcagatgtaggagttactttaatagctgttttaaactctatgagggcattaaaattatagaattatatatgtagaaataaactgattaaaactaaaatattttgtttttatcagtttatttcttttacagaaaaaccaattattttaaaatcacataatttttagaatgagtaggaatactataaataattaatataagagaaaagttgattgagagataattgggaggagtattatgtcgattatatcaattctattaacagctattggattatctatggatgcatttgcagtggctttaacaataggtatgaatataaataatgtagatagaaataaaatagcaataaagtcaggaatatattttggtatatttcaaggaataatgccatttttaggttggatattaggtataaaattcacaaaatatattcaaagcattgatcattggatagcatttgctttgctgactttcataagtataaaaatgataattgatggagttaaacctaatgaagaaaataaaataaaagaatatagtaataaaacattttttatattggcaattgctacaagcatagatgcattagcaataggagttacgtttgcttttttaaatataaatatattatcagctatttttataataggaattacaacttttgttttaagtgttagcgctgtatatcttggtaaagttataggaaatgtaataaaaaataaagcaggaatatttggaggattaattttatttattatcggtttgaaaattttattagaacatttaggagtgataaaaatatagattttatacttgacataaaattatataagtatggtattattattaaacatagagtataataaattggtgtgtactttataaatcttactaaataaagtaagtattagaataactgattatgacaatacttattattaatacaagataaagaagtataaagtttatttgatatgtgtttattttaggataattagttataaatataaaatggattgttaaaaattagactaaattaaggagaaaaaaagatggagaaaagtaaaaatatatctatggcagttataaagagattgccaaagtattatagatatcttggtgagcttaagcgaaatgaagtagatagaatttcttcaaaggaattaggggaaaagataggatttactgcatctcagataagacaagacttaaattgttttggagactttggacaacaaggatatgggtataatgtaacagaattatataatcaaattaagtctatattagggctagatagaggatacaaggcagcattagtaggtgctggtaacataggtcaagcagtatctaattattcgagatttgaagatttaggttttaagattagtacaatttttgatgcaaatccaaaactcattggaatgaagataagagacgttgaaattgtggatattgatgaaatgaagcctatattagaaaatgagaaaatagatattgggataatctgtgttccaagaaaaaatgcacaaacagttgctgatgatttaattaaaggtggagtaagagctatttggaattttgctcctgtagatttaattgtaccaagtcatgtgaaagtagagaatgttcacttaagtgagagtttactaacattgatatatcttttaaatgaacaagataattaagacataagagaaaaatcacattgtaaattattgatttatttacaatgtgatttttttatttttaaagaaaggaatgtacaaaatagaaagtttaaactgttaatatatttatacaaaaaattaatataaatactaataatgaaaaaaaagaattaataaaaaaatacttaaaaatggtaatattttattgcaaaaaatttaacaaagtattataatttgatataaggagcatggctccaattattttacttacatttgttataatattaacaaatgaatgagtgaaatcattattctaaatagtaagaaaattaaaaaaataaaaataagccaaattgaagggggatcctagtatggaattagaaaatgtgattcttgaaaaagaaggacatttagcaattgttacaattaatagacctaaagctttaaatgctttaaattctgcgactttaaaggacttggatacagtattagaagatttagaaaatgatactaacatctatgctgttatcttaactggagcaggtgaaaaatcttttgtagctggagcagatattgcagaaatgaaagatttaaatgaagctcaaggaaaagaatttggagaacttggtaataaagtatttttaagattagaaaatttaaacaagcctgttattgcagcaatacaaggatttgctcttggtggcggatgcgaaatatctatggcatgtgacataagaatagcatctgaaactgcattatttggacaacctgaagtaggtttaggaattacaccaggatttggtggaactcaaagattagcaagaatagttggactaggaaaagctaaagaaatgatttatacagctagaaatattaaagctgatgaagcttatagaataggattagttaacaaagttgtagctttagaagatcttatgaatgaagctaaaaaaatggcttcaaatattatagcaaacgctccagtagctgttaagttatgtaaggatgcaataaacagaggtatgcaagtaggaatcgatgaagctgttatgatagaagctgaagattttggtaaatgttttgctacagaagatcaaactgaaggaatgactgctttcttagaaagaagaaaagaaaagaatttccaaaataaatagtattttaatatggtaaaaatccattacagatttatatatatgttatcaaggttttaattaacaaggagggcaatttaatgaatttccaattaactagagaacaagaattagtacaacaaatggttagagaattcgcagtaaatgaagttaagccaattgctgctgaaatcgatgaaactgaaagatttccaatggaaaatgttaaaaaaatgggtgaattaggaatgatgggaatcccattttctaaagaagttggaggagctggcggagatgttctttcttacataatttcggtagaagaattatcaaaggtttgtggtacaacaggagttatactttcagctcatacttcattatgtgcatcagtaataaatgaaaatggtacaccagatcaaaaagctaaatatttaccagatctttgctcaggtaaaaaaataggagctttcggtttaactgaaccaggtgctggtacagatgcagcaggtcaacaaactactgcaagattagaaggtgaccattatgtattaaatggttcaaaaatcttcataactaatggtggagttgctgaaacatttatagttttcgctatgactgataaatcaatgggaactagaggaatatcagcatttatagttgaaaagtcattcccaggattctcaattggtaagttagaaaacaaaatgggtattagagcatcttctactactgaattaatttttgaagattgtatagtaccaaaagaaaacttaattggtaaagaaggtaaaggcttcggaatagcaatgaaaactcttgatggaggaagaattggtattgcagctcaagctttaggtattgcagaaggtgcttttgatgaagcagttgcatacatgaaagaaagaaaacaattcaataaaccactttcagctttccaaggattacaatggtacattgctgaaatggacgttaagatagaagctgcaaaacacttagtatataaggctgcttggaagaaacaaaatggtatgccttattcagttgatgcagcaagagctaaattatttgctgctgatgttgcaatggaagttacaactaaggctgtacaattatttggtggttatggatacactaaagaatatccagtagaaagaatgatgagagatgctaagataactgaaatctatgaaggaacttcagaagttcaaaagatggttatcgctggaagcattttaagataggaggacttttagaatgaatatagtagtttgtgtaaaacaagttccagatacaacagctgtaaaaattgatccaaagactggtacattaataagagatggggttccatcaataataaatccagaagataaacatgctttagaaggtgcgttaagaataaaagaagcaactggtgctaaagtaacagttgtaagcatggggcttccaatggctaaagcagctcttagagaagcattatgtatgggagctgatgaagctattttattaacagatagagcacttggaggagctgatacattagcaacttcaaaagcattatcaggagttatagctaaattagatgctgatatagtatttgctggtagacaagcaattgatggagatactgcacaagttggtccagaaatcgctgaacatttagatattcctcaagtaacttacgttcaagacgtaaaagttgaaggggaaacattaatagtaaatagagcattagaagatggtcatcaagtagttgaagttaagactccatgtctattaactgcaattgaagaattaaatagcccaagatatatgaacgttgcaagaatatttgaaactaacgatgatgagatcaaagttatgggagcagcagatatagatgtacctgttgaagaattaggacttaaaggttcgcctacaaaggttaagaagtcaatgactaaagaagttaaaggtcaaggtgaattagttaaacaagaacctaaagacgctgtaacatacgttttaggaaaattaaaagagaaacactacatctaagataataggaggttaagtaattatgaatatagcagattacaagggcgtttgggtctttgctgaacaaagagaaggcgaattacaaaaagtgtctttagaattacttggagaaggaagaagacaagctgataaactaggagttaagttaacagcattattattaggaagcaatattgaaggattaagcaaaacattagcagaacatggtgctgatgaagttttaattgctgatgataaattattagaacattatacaactgatgcatatacaaaagttatctgtgacctagtaaatgaaagaaaaccaggaatattatttgttggtgctacttttatcggaagagatttaggtccaagagttgcagctagattaaacacaggacttacagctgactgtacatcaatagatgtagaagttgaaaatggtgatttattagctacaagaccagcatttggtggtaacttaatggctacaattgcatgtcctgaacatagaccacaaatggctacagtaagaccaggagtttttgctaaagttgaaagtgatggagctaactgtaacatagaaaaagttaatgtagaattaactgattctgatgttagaactaaagtattagaaacagttaaaactgctaaagatatcatagacatatcagaagctaaagttattgtttctggtggtagaggtgtaggatctaaggaaaactttgcattactagaagaattagctaacatattaggtggaacagttgctggttctagagcagcagttgaaaaaggatggatagaaaatgcttaccaagttggacaaactggtaaaactgtaaaaccatcaatttatatagcatgtggtatttcaggagctatccaacacgttgctggtatgcaagattctgatatgattattgctgtaaataaagatgaaactgcgccaataatgaaggttgcagattacgctatcgttggagatattaaaaaggtattacctgaattaattgctcaagcaaaggaaattgtagaagctgaataattaattgattatagaaaaacagtagtggattttagagcggaatttaattaataaatttatataaaattttggttaatatattatgtatttactatatctaaggccagaaatatgcctggtcttagtattttaaataaatggaacagaaatatatatatttaggaggaatttattcatgaaaaaagtatttgtacttggtgcaggaactatgggtgctggaattgttcaagcatttgctgcaaaaggttgtgaagtaattgtaagagacataaaagaagaatttgttgatagaggaatagctacaataactaagtctttatctaaattagtggctaaagaaaaaattactgaagcagacaaagaagaaattctttcaagaatatcaggaacaactgatatgaaattagctgctgactgcgatttagtagttgaagctgctattgaaaacatgaaaattaaaagagaaatatttgctgaattagatgaaatctgtaaaccagaaactattttagcttcaaatacttcttcattatcaataactgaagttgcatctgcaactaagagagctgataaagttataggaatgcatttctttaatccagctccagttatgaagttagttgaagttataagaggagctgctacttctcaagaaacttttgatgctgttaaggaaatgtcagaatcaataggtaaaactccagtagaagttgctgaagcaccaggatttgttgtaaacagaattttaatccctatgattaatgaagctactttcattttacaagaaggtgttgcaaaggaagaagatatcgatgcagctatgaaacttggagctaaccacccaatgggacctttagctttaggtgaccttataggattagacgtatgtttagctatcatggacgttttatacaacgaaacaggagatagtaaatacagagctagcagtcttttaagaaagtatgttagagctggttggttaggtagaaagactggaaaaggattctacgattattctaaataattttaactttataatatcccgttaaataaatatactcctagaagcagtctgcttttaggagtttttgtgatggaaattattaacataaattatcattaaaggctgtataaaatgtaagttttatgcagtttatttaattttacatatgtactatagttttagttcataaattataaagtgtaaattgaaacataatatatatgttcatataaaaataaagttatccatgatataattataattgttaattaagtataattatccataatctttatgcaatgatttgattatactaatagagattattaatttagttacaagtggaattacaataaacaaatataaaggtggtaatgaagatggactataaacaaataaaagaatatgataattatttagtaatagaagatgttaaaaattttaagttaaagcagacttttgaatgtggtcaatgttttagatttcataaaataagtgatacaaattacataactgtagcatttgaacgtgttatagaacttgaagaagacggaaatgatataaagatatataattctaacagagaagatgttgaaaatatctggattgattattttgatttaaatagagattactccaaaattaaagaagaattatcaaaagatgatttgttgagaaaaagtgttgagtatggtcctggtataagaattttaaatcaagatccatttgagatattaattagttttattatatcagctagaaatagtattccttcaataatgaaaacaataaataagatatctgcaaaatgggggagaactatagagtacaaaggaaatacatataatgcatttccaacaatagaacaaataaaagatgctacattagaagagattcaagaaacaggagcttcttttagaagtaaatacattatagatacaatttcaaatgtatatagtagttataaagctaaaaaagacaaagactccgaaaaaatagaagaatttaaaaaatacgatttggagtatataaaaagtcttaatgatgatgaatgtcatttggccttacaggaatttaaaggtgtaggtgcaaaggtggcagattgtattatgcttttttcaatggaaaagtattcagcatttccagttgatgtatgggttaagcgtgctatgatttatttttatggagcagaagatgcatcattaaataagataagaatatttgcaagaaatcaatttaaagaattatcaggatttgcacaacagtacttattttattatgctagggaaaataagattacaattgattaatttaataaatatagacaaaaattaaaggcaaggtataatcaccttgcctttaatttatatattattttaaactcaagatatttcttagaaacaccttcattaattttctaatttaaatcaactactttttctaactcgacgtgatttttttattggaacgtaagaatccccaggtatattctctacgaactttaaatattttttaatcttgaaatccttttttataagttctagtgagttaaatctagatgctaattcacggtttgtaaatagtgcatgaatagcacaatgacaagttggacataagtgtattgtatctaattttttaccgcctttttctaatggtatcaaatgatgatttgttattatcgagacacttctattacacaattcacaaatatggtattgggccataaaatcctcctcgtatataaaaatatatttcatgtattaattatatcataatagaatttaaaatcaaaagagtttagtattttataggaatagcattaaattaactataaaactatgttataattatacaataatgtaaaatacaaacataaatatagaggtggtttaatgtttcaatttgaaaatcagttggctaaattaaagcatgaagttttgactagagtggctgtacttgcaaagcagaataatctaacaagagaagaaatagaaaaaattccatatgaaatgatacaaggagatattcctaaatatagagataatgttcaacatgaaagaaatgtggttttagagagagtaaaacttgccgccggctatcttccaaatggaagatatagtgaagaattaatagatatatctgaaaataaacaaattttatatgtcataaaagcagcatgtgatagatgtcctacaaaaaaatttgaggttactgatgcttgtagaaattgtatagcgcataagtgtcagagtgtatgtaattttggagctataagttacgttaatggaagagcgcatatagatacaacaaagtgtaaggaatgtggaatgtgtaaaaaagcatgtccttatgatgcgattgcacaagatatgagaccttgtaagagagcgtgccctactggagccataaattttaataaatacgatttaagcactgaaataactgaaagtaagtgtataaattgtggagcatgtatggcatcatgtccatttggtgcaatagaggataagagcagtatagttaaaattgttaatgaattgatgtctgataatgatatttatgcagttgtagcacctgccataacaggacaatttaatataaatgttaaatatggacaagtaaaaaatgcaataaagaaattaggttttaaagatatgacagaggctgcgtgtggagcagatgccgttactgtacatgaaagcaatgaatttatagagagaatgagtataggagattcttatatgactaattcatgctgtccaggatttgtaagctatattgaaaagttagtaccagatcaatcttcaagaatatcaagtaccgtatcaccaatggttgctacaggtagatatataaagaataagaatgcgaatgctaaagtagtatttataggaccatgtacagcaaagaaaaatgaagtactaattgagagtattaaagattctgtagattacgtactaacatttgaagaactatttgcgttattcgatgcttttgaaataaatccatctgagtgtgaagagattacagttgatgatggttctatttttggaagggggtttgcaataggtgggggactaaccgcttctattgaaaactatatttctgaaaagggaatagaaacagaatttaagccagtaaaagtttctggtggatcagaaattaaaaagactatgataatggctaaagcaggtaaattaaatgggaattttattgaaggaatgatgtgtgaaggtggatgtattaatggtgcagctaaagttatttcttctgtaaaagctaaagctaactgtgtgaaaaataataaagaaggagaaatcaaaagtgtcatgtctaataaaatattagatgaatttgacaatataagcttaaagaagtgatttagcaaaataaaagtttttaaataaaacttgtaaaatctctttaaaacctcagaaaatatgagtaattttaaagagatttttcttgtaattaaagtcatttatataaagaaaaaacaagatttattttgcttactataattttgagaaaattaaagaaaaaatgagtattggcgatttattcagaaataaacggtaatatttacagaaaaacaggatataatattggaagtaatgtttgaattatatggatataaacgctattataattatattagcactcgatgatgatgagtgctaacaattgaaataaaaataataaaaataataatatatatattttaaggagggttttttcatgaatattaaaccacttggtgaaagagtagtaattaaaaaattagaggcagaagaaaagactaagagtggaatagtcttaacaggaagtgctaaggaaagaccacaagaagcagaagtagttgctgtaggtccaggcgcagttgtagatggaaacagaattgaaatggaagttaaagttggagataaggttttatactctaaatatgcaggaacagaagttaaagttgatgggcaagaatatactatattaaaacaagaagatatattagcaatagttgaataaaatcaattagaatgaaattttaagcattaataaatggatagaaagttaaattaagaggagtgtgttataaatggctaaaatgttaaaattcggagaagaagcaagaagagctatgcaaataggtgtagataaattagctgatacagttaaagttactttaggtccaaaaggaagaaatgttgttttagataaaaaatttggtgcaccattaataacaaatgatggtgtttcaattgcaagagaaatagaattagaagatccatatgaaaatatgggagctcaattagttaaagaagttgcaactaaaactaatgacgttgcaggagatggtactacaactgctacattattagcacaagctataatcagagaaggattaaaaaatgtaacagcaggtgctaatccaattttacttagaaatggtataaaagtagctgttgaaaaggcagttgaagaaattaaaaagaattctaaacaagtagaaggaaaagaagacattgctagagttgctgctatttctgctgctgatgaagaagttggtcaattaattgcaaatgctatggaaaaagtaggtaatgaaggtgttatcactattgaagaatctaaatcaatgggaactgaattagatgtagttgaaggaatgcaatttgatagaggatatgtatcaccttacatggctacagatactgagaaaatggaagctgttttagaaaatccatatatcttaataacagataagaaaataacaaacatacaagaaatattacctatacttgaagagatagtaaagacaggtaagaaactattaatcattgctgaagatattgaaggtgaagcaatggcaacattagtagttaataaattaagaggaacatttacttgtgtagctgttaaggcaccaggatttggtgatagaagaaaagaaatgctacaagatattgctatcttaactggtggtactgtaattgctgaagaattaggaagagatttaagagaagttactatagatatgttaggaactgctgatagtgttaaagtaagcaaagaaaacacagttatcgttaatggtaaaggaaattcagtagaaattaaagaaagagttaatcaaataagagctcaaatagaagaaacttcttcagaatttgataaagaaaagttacaagaaagattagcaaaacttgcaggtggagttgctgtaattaaagttggtgcagctacagaaactgaattaaaagaaaagaaattaagaattgaagatgcattaaatgcaacaaaggctgctgttgaagaaggtatagtagctggtggtggaacagcttatgttaatgtaatcaatgaagttgcaaaattaacatctgatgttcaagatagtcaaatcggtataaatataatagttaaagcattagaagaaccagtaagacaaatcgcaatcaatgctggtgttgaaggttcagtaataattgaaaaagttaaaaatagtgaaccaggtgtaggatatgatgctttacatgatgaatataagaatatgcttaaatcaggtatagttgatccaactaaggttacaagatcagcacttcaaaatgctgcatctgtagcatctacattcttaacaactgaagctgctgtagctgatattccatctaaagatcctgtaatgccaggtggagctccaggaatgggaatggacggaatgtactaaaatttaatataaaaaattaattatttatttaatataaaagattgatagaaatcccaatatagatttctatcaatctttttttataattatgaatacaaaatatataattggtaaatataggaatataaagtaaaaagggaggttttatatgcatttaagagaatcaagaaaaaaacaaaaaaagaaaaaagcttttactataattgagttggtagtagttatgtgcatcgtgggaatattagccagcgcattaataccacaagtgggtggttatataactgaagctaaaaaaatgaaagtagtagatcaaagcagaagtgtagtaatggctgtagactcatataatttgaaaaataaagtaaaatatcccgaagataaaacagttagtcatattaaaagtgaagctggaatttctaaatatctaaaggatgttaaatttgataatcttaaagataatacgaaaatagaggaatgtagaagtattgttaatggttcagaattcacaatagatgaaaatgaacagttagaaaaagtaacagcagtaatacaaccagatgatttagagatagaataaaatataatattttataaattttttattagactacttgagatatttttaagtagtctaataaaagtaatcattaatttgaaaaataatacataaaaaatgcaatttttgtgtcaagtttattgactttattttttacatacattataatatgtttaattcaaagatacggcacattaaaaaactcatatataccctggatatggcagggagtatctaccggaaaccttaaatttctgactatgagtgatattaatataagctgatattaatttattattagcatattaacatcactcaggatgattaatgtgctttttttatacacaaaaataagggtaaaaatgcaataaatatttcaaaatcaataagaaatgcaataaataattcaaaaatagggaggaaatttaaaatggcaaaaattattaaagaagcttatacttttgatgacgtattattaatgcctaacaaatcagaaatattaccaagagaggtaactacaagaacacaattaacaaagaagatagctttaaacataccgcttatgagtgctggaatggatactgtaacagaatctaagatggcaattgcaatggcaagagaaggcggaataggaattatacataaaaatatgactattgaacaacaagctaaagaagttgataaagtaaaaagacaggaaaatggtgtaatcacagatcctatttatttatcagaagatcatcttattcaagatgctgaaaacttaatggcacaatatagaatatcaggagtacctgttactaaagacggaaaattagtagggattattacaaacagagatataatatttgaaacagattttcaaaagaaaatttcagatgtaatgacaagtgaaaatttaataacttctcatgaaaagactacagttgaagaagctaaagaaattttaaagaaacataaaatagaaaaattacctttagtagatgcagaaggaaacttaaaaggacttataacaatgaaagatatagaaaaagttaaaaagttcccaaatgcagctaaagatgaaaaaggtagattattatgtggtgctggtgttggtgttacaggaaacatgatggaaagaattgatgctttagttaaagctcaagttgatgttattgttcttgatacagctcatggacattcacaaggagttttagacgcagttaaaaagataaaagaaacttatccagaacttcaagtaattgcaggtaatgtagcaacagctgaagctgtagaagacttaatagaagctggagcagattgtgttaaaattggtataggacctggttctatctgtactacaagagtagttgcaggtgtaggggtacctcagttaacagcagttatggattgtgctgaagtcggaagaaagcatggagttccagtaatcgctgatggtggtcttaagtattctggtgatatagttaaagcattagcagctggtgcatctgtagcaatgcttggatcattatttgcaggatgtgatgaagctcctggagaaatggaaatatatcaaggaagaagttacaaagtttatagaggtatgggatcacttgctgctatggaatgtggatctaaagatagatacttccaagaaggaaataaaaaattagttccagaaggtgtagaaggaagagtagcttataaaggatttgtagcagatactatattccaattaattggaggaataagatcaggaatgggttacttaggatctaaaaacttagagacattatatgaaactgcaagatttgtagttcaaacaggtgctggattaagagagagtcatccacatgatataaatattacaaaagaagctccaaactacagtgttggacaatagacgaatattataattaaaaaataatcaaatgttaataaaaaatgcccaaaataaatatttttatgttgaaaaaaatatttatttgggcaataatagtatgtattaagaactttttaggaggaaaccatgaaaaaagaattaattttagttattgattttggtggacaatataatcaattaatagcaagaagagtaagagaatgcaatgtatattgcgaagttcatccttatactttaagtgttgaagaaataaaggaaatgaatccaaagggaattatttttacaggtggaccaaacagtgtatatggtgaagattctcctctatgcgataaagctctatttgaaataggagtacctattcttggtatatgctatggttctcaacttatgtctcatatgcttggaggaaaagttgcaacagctcctgtaagtgaatatggtaaaacagaagtagatgtaaaggtagactctaaactttttgatggtgtatcatctaaaactatatgttggatgagtcacactgattacatagaaaaagctccagaaggatttaagataactggtaatactcctgtttgtccagttgcagctatggaatgtgaagaaaagaatttatatgcagttcaattccatccagaagttatgcatacacaagaaggtacaaagatgcttaataactttgtatataatgtatgtggatgttctggagattggaaaatggattcatttgttgagaagacaattgaagaaattagagaaaaagttggaaatggaaaagctttatgtgcattatcaggtggagttgattcttcagtagcagcagtattgctttcaaaagctattggaaaacaattaacatgtgtatttgttgatcatggtttacttcgtaaaaacgaaggagatgaagttgaagaaatatttggacctaacggtcaatatgacttaaactttatacgtgttaatgctcaagaaagattttatgaaaagttagctggagtagaagatccagaaactaagagaaaaataattggtgaagaattcataagagtttttgaagaagaagctaaaaaaattggagctgttgatttcttagtacaaggaactatttatccagacgtaatagaaagtggtcttggtaaatcagctgttataaaatcacatcataatgtaggaggtcttcctgattatgttgattttaaagaaatagtagaaccacttagattattatttaaggatgaagttcgtaaagcaggtttagaacttggaattccagaaaaattagtttatagacagccgttcccaggtccaggacttggtattcgtataattggtgatgtaactgctgaaaaggtaagaatagttcaagatgcagatgcaatttatcgtgaagaaattgcaaatgcaggtattgataaagaaataggtcaatatttcgcagctattacaaatatgcgttcagttggtgttatgggtgatgaaagaacttatgattacgctatagcccttagagcagtaacaacaagtgactttatgacagcagagtctgctgatcttccatgggaagtacttggaaaagtaacaactagaatagtaaatgaagttaagggtgttaaccgtgtaatgtatgattgcacaggaaaaccaccagcaactattgaatttgaataggtagtatacatatctatcacatataaaaaccttactaatttttgaaaataaataaaaattggtaaggttatttttgtgattataattctttttgatttttagagtttatatatttattagaaatttctttcctagacaactcttattaattaatgtattgagataaatggattaatatggtattctgtaacagacaaagaagctaatcttgaagtaacataagtgcagaggtgaaagtatatgtttttatatcattattatgacaaaatgactggtccatttatgaatctatctgagttagcaaatgaggaagctaattttattttaaataaaataaaagaaaacaagccaaaagcgcaaagtgcacaacgggattatgaatatatgtttagaagacgtatgtatgaggatatattaagaaaagagtttttgaaaaaaggtggaattatcaaaagagatgttccacattatatggttgttgaacatagtccatggttaagcacatggtttgaaaatagtagctttgttcgaatatctatagaggaatttgatacaaaaacaatttcgtttacttatggagattcacatccaacattcagtccatggccaagagatgatgattggaaagaatatcgtagaaaactttatacatacgaagagatactggagataataaaaaagtatggattgcctcaagattggaacaatgatggtaattatggtccagaaagatatattgaagcgcatatatggagtgatgatacaataaataaatatcgtatattttgagcaggctctttgcaatagaaaatcagcaagtcaaaataaaatatgtaatatagataaaataaggctatttatcgtataaagcttaatcatatatatttagtgattgcgatgaactaacgaatttgaataatgttttataataaaatcttgaaaaaactatcttaataggtttattaggattttttcttgattgatatgaaaaatataatacatagttgaaaattggattaatgatagttattataagaattaataatggatataaaagtgaaatttataaataacaatactagatgaggtaataaaatgagaacacgagtaccagattattttaaaaaatttaaatgcattgcttcagaatgtgaggatacatgctgtgctggatgggagatagtagttgatgatgaaacatatgattattataaatgtgttaaaggtaagtttggaaacagattaaaaaatgaaatagtgcaagatgaagatggggacaatatttttattcttaaaggaaatagatgtgcatttttaaacgatagagatttatgtgatatttataatgaacttggagaagaacatttatgctatacatgcaaggaataccctaggtttacagaagagtttggaagtatacgtgaagtaggattatctttatcatgtccagaagcagcgagaataatattaggaaaaacaaatatcactgaatttgatgttgtagaagatgatgatatggtatcagcttataatgatataagttatgatatttttatgcaactttcaacatcaagaaatcttattatgaatacaatacaaaatcgttctatggaattaagtcataggatatctattattttaagttttactgatgaaattcagaaaaaaatagatgaagataaaattgatgaaataattcaggttagaaaaaaatattctgatgataaatttataaacaactacgttgatagtttgaaaagtttaaaaaacaataaagaagctagatatgataacataaagaaatattttgaagtgtacaaagatattgaccatataaatgaagagtgccctttagttttagatgaagcaataaaacatttttatggggaaaattcaggttttgaattttatgtggaaaaacataataaatttaagtcatattatgtggatagaatatatgagtatgaacaaattatagtatattttatatttagatattttatgaaggctgtttttgattatgatgtatctgcaaaaattaaaatggcagttataagtatgttgataatagaagagttagatgtggttagatggtgtaaaaataatgaagaatttaacttgagtaatcaagtagatatagtaaagctgtattctaaagatattgaacattcagaagaaaatgtagagtcactttatgaaagctttgaaacaaagagtatatttaacttggaaaatctattaataataataaataactaaaaaggctaaccaaaagagtataaagattatattataatacttgtaggaaaattgttttacatcccaaaatgtagcaaaatataatgttatagtatttaattaagttcagatttatagattgtaataatataagtctgggcttttttatatttacataaatctatgaaaatgaatcatataaaatgataacaaatcgagacttctagcataatataatatcaggtaattcttaagtttcacggaatactaattgaagaaatttagaaagccatagattctaaaatattgaaaaaatattgaaaaaatatttaaatttgaatattaacaaatgctatagagcattatgttttgctacaaaggagagaagaacatgaaaaacagaaagcatggttgctgtcaaccatataataaatgtagttgcaaagaaaaaagttgttggggtggaaaaaaatcttgtaataaatgtacaagacattgtcactgtacaccagagtattcttcagaaagtacaccagagtgtggatatgattgtaatttaagttgtgcttcagaagaaattcactgttgcaattcttgtggctgtggaaaagataaatgtcatagtgcatgtacaccagaatgcacaccagaatgtggatacgattgtaatttaagctgtggttcagaagaacgtcatggctgtaattcttgtggatgtagaagagataaatgtcatagtgcatgcacaccagaatgcacaccagaatgtggatatgattgtaatttaagctgtgtttcagaagaacgtcatagctgtaattcttgtggatgcagaagagataaatgccatagcgaatgtacaccagaatgtcctccaaaatgcacatcagaatgtggacatgattgtaattttagctatgcttcagaagaaatagattgttgtgaatacagaccacataaaaaatgcagatgtcatacagtatgtacaccagaatgtcctccaagatgtactccagagtgcgagtatgattgtgactttagttctgtatctgaagatatgagttcaagtgatgataattttagctttagctcttatgaaagatcttgcgatgaaccagaatgtggccgttcaaaatctgattgtaattttattagccatagatgctgtgatagttgtggcgaatgcttcataggcggaatagaagaaggatattgtgaaggctatgaagaaggattaaaaaagaaatgcaaaaatcaatacaaatgtggatatgatgcaggatacaaagaaggttatgatgctggatacgaaaaagcaaaacaagaagttcaagcatatgttgataaagtaaagaaatgcagaaagaacaaatgctgttgtagattctaaatttaaaatattaacaataatcatttaatattttaataaataagaggaatagtgtatatctattcctccttatttttttcattattattataaataatagtacttaaatttctctagatgcacataataaattatagaaactactaaaaagtttctgcaattataataataaaaaaaatcgtatagcaagtaattaaatacataatttatgttataatggaacaatgaagaatattttattgtatatggaggtagaagaaaaaatgaataaaggtatatcgttagatttatcaaaagtagcaccttatttagctacatctgaagttgactatatggaagatatggtgaaatgtgcacatgataaattacacaatggaacaggcgcaggtaatgacttcttgggatggattgatctacctgttaattatgacaaagacgaatttgaaagaataaaaaagtctgctgaaaagattcaatctgattcagaagttttaatagtaatcggaatcggtggttcatatcttggagctagagcggctatagaaatgttaactaataatttccacaatgcattagataatgataaaagaaaagctcctaagattttctacgtaggaaacaacataagttcaacatatatggcagaacttttacaagcaatagaaggtaaggatgttagcttaaatataatatctaaatcaggaactacaactgagcccgcaatcgctttcagaattttaaaatcatatgtagaaaagaaatatggtgttgaagaagctagaaagagaatctatgctacaactgataaagcaaagggtgcattaaaaacattagctgattcagaaggatatgaaacattcgtagttccagatgatgttggaggaagattctcagtattaacagcagttggattattaccaatagcagcagctggaatcaatatagatgaaatgatgaagggtgcagctgatgctagagaagcttattcaaatccttcaataaaagaaaatgatgcttataaatatgcagcagttagaaatgctttatataataaaggaaaagtaattgaagtattagttaactatgaaccatcactacattactttaatgaatggtggaaacaattatatggagaatcagaaggaaaagataacaagggattattcccagcagcagttgattttacaactgaccttcactcaatgggacaatatattcaagaaggaagaagagttctttttgaaacagttattaacgttgaaaagccaaaatatgaaatcaacattgaaaaagatgctgatgatttagatggattaaacttcttagctggaaagactatggattttgttaataagcaagcattccaaggtactttattagctcataatgatggtggagttcctaacatggttgttaatgtaccagaaatatcagcatactattttggatatatggtatacttctttgaaaaagcttgtggtataagtggatacttattaggtgtaaatccatttgaccaaccaggtgttgaagcttataagaagaacatgtttgctcttttaggtaaaccaggatatgaagaaatgaaagctgaattagaaaagagactttaattctaatgaagataataattgatggagatgcctgtccgggtatctccattattgaaaaagtagcaaaaagctataaagttgaggttgttatattttgtgatataaatcattttattcaaagtgactatagtgcagtaaaaattgtagatagtggttttcaaagtgttgacatgtatgttgttaatgaaacgaaagaaaatgatatagtgatttcgcaagattatggagttgcagcaatatgtcttggaaaaaaggcagaagttttaaatcccaagggacatatatataatgaaggaaatattgatagacttctagaagaaaggcacatatcacaaaaaataagaaaaggtggagggagaactggtaatcctaaaaaaagaacacctgaagatgatcaaagacttgaaaaaaatttaacatttgtaattaagaaaaatatcatgaagctgtaaggcttctttttttatataaatatgttaaaaatatatttatataattatataatttattaaaatggtaaaaatagtataaaaatttctaaatatataagaataattaagtatgtatgatataatttaaataaaaccactcgctctcaatttacaaaaaatggaaaaagagtataatataattatgctgtaaaattatgtattcggagggtttggtttttatgaatgaagttcaatcaaaatatatagaaattatttttgataaagaaaagccacaaagtgttgatacttcaataagaataaaagtaaaagcagaaaatatcattgaagaattagaatataaatttcttattggtaagggagggatttggtctgttattaaagatttctccaaaagtaatcaatgtttatgggttccaactgaagatggaaactatataattatggtacaagccagagaaaagttaaaggctagaccattggattatttagctaaagaagaattttcaatagttaagggagagatttcacagcctatgaaagaagaatttaaagataatactgaccatgaaaattattctgagattggtagaataacagaagctgattcaaacgaatttaaagaaataatgagtgaaactaatgataatatattatttttaaaggcttcacaggtgagtcctgaagagaagaagactttgatgaagggaatagatgaaactatggatgaaactagggatgaaatggcagttactagagatgttattgacttaaaagaaattgaaaagagagtagaagttgagaatagagaagatgatgaaataagtaaattcaatagtgaaaagataatgagtaaattatctgaaaagtccttaaataatgatataaatagtattgatgatacttataatgaaataatagaagacattataattgaaaaaaataagatttttgttggtgaaaaagcagttataaaagttaattctatagaaaaagaaacgtatttatataaattttatattaagaacaataatgagtggtccataataaaagagtacgatacagataatattttagtatacactgcaacacagcctggaagaatggaatttttagttcaatgcaagagacttaattcaacagacaattttgatgattttagaattatagatatagatgttgaagaaaacgaaaaagtagaaatagttaatataaaatgtttatcaaccgaattgatttgtggagaagaattagaatttgctgttgatacaaatataaaagagaataatggacaagtgatactttataaattttataaaatatcaaaagatggaagatcatcatgcatacaggattattcaacaaatagcaatgttcaatttattgagcctcacgacgggacatatagaatattatgtcttgtaagaagtatattatccaataaagaatatgatgatagagctgtacttatgtacaaggttaaaccatatacagatataaaaataaaagattttatagctgatttaaattcacctcaagctactgaaactgaaataatatttaattctgatgtggagggtggaaaaaacctattatacagatataaagtaaaaggtccgatagaagaagatactggttttacaataagtaatgaattttcgtggaatccagaagagccaggagagtatgaagtatttctttatgtaaaggataagatgtttactggtgaatatgaagatagtagaaagattgcatttactattgagaagcgtggaaaaaagccaattaaaattttagatgttattgttgataaagagaaaaaaattattattggagagactgttaatataatggttcatgcagaaggtggtacaggcttactttattcttttataataaaaagggatggcagacttattgaagaatccaaatacagtacatcaaattggattgattttactcctgatagggttggtgaatatgaagtcgaaataaaagttaaggataaatattctgaaaaagattttgatattcataatttaatatatttaaaagcaatggaatatattcctggagaaatagattatattttattaccttataaagaaaattatttaataggtgatgcaatagagtttgaatgtatcagtcaaaatacaaatgaagtgttgattaaatatgaaaccaaaataaatggacaatcaatagaacagactgaattttctaagaataagaaacttagggttattcctaaaacaccaggaaaatatactatagaagtttgtgctaagaatataaaatgtgagaaggaatttgattctaaaaaacagataagtttgtatgtaaatgaggcttcaccagtattaaatacaaagataatatcaaataaaattgaaggaaaagttaatgaagaattttctattgaagctacaagcagaggtggaaaagatgtttgttatgaattttatttaatggaaaatggtcagtggaaaaaagtacaatcatatagtaaaaagaatttttatagctttataccttttacaagtggaaaatataaaatattagctttagctaagagttattataaaaaagtgagctatgaagattatagtgaattgaatttttgtgttaaagattaatttgtaataaacgaaaaataactataagaagagtgtgaagggagaacaattaagatgccgatagatggtttgagtaataatatatctaacgaacaattaatggcaatgtcgttgatgagtaatggacagttaactaatgagtcaacatcatcaactgaatctagtgagtacaacaatttagcatttcaaatgatgatgaaaaactatatggattcagccaaaaatacagctaaagacaatgttgataaaatagtcaacaattcaaatacagaaactaataattcaacaacagaagtgaagaagcaaacggatgcatccgattcaatcaatgcagcagcagcttctaatcaaacttcaagagcggttcagaattatcttgcaggtcaaaagttaacagatattcctttgactttaaataattcatatggaaatatatatagttcaggaacttctatgttgaataatagaacaccagaggatttaaagaaaatatattcagctgtaagtgatgcatcaaaaaaatacggtataagtgaatctcttatacttgcagttataaaacaagaatcagatttcgattcaacatgtacatcgagtgtaggtgcatcagggctaatgcagataatgcctggtaattattctcatcttggaataagtgatccttatgatgttgatcaaaatgtaaatggtggaactaaacttttaagagaatatttagataaatataacggtgatatacagatggcattaatggcgtataatggaggacctggaactatgcaaagaagaggagttacatcatctgatgatttgtataagatgccagaagaaacacaaaattatgttccaaaagtaatgggatattatcaaagtggagtatgattttagttaacagttaacggttaataagtaacagttaattaataagagttatattataaatataggtaggactattctaaattttttttagaatagttctttttaaattgatataaagctatgaatacaatagttaattgtataattgcaacatgatttggtataattaattaacataaagtaaaatgatgagataagaaagagaagtgaacatatggaaagattagataaggttatttcaaatttaggatacggaagtagaaaagatgttaaagcatttgttaaaaaaggattaattgaagttgatggagttattgttaaagataacgggctttctgttgatccagagaaatctgttattaagattaatggagaagaggttttttatagaaagtacatatatttaatgatgaataagccagcaggagttatatctgcaactcatgataatagagatgaaactgttatagatcttttatatgtagatcatcaagtttttgaaccatttccagtagggagattagataaggatacagtaggattattattgcttactaatgatggagaacttaatcatagacttatatcccctaaatggcatgttgataaagtatattatgcaaaaattgacaaaaaagtagatgaaaaagatattcaagcatttaaaagtggtattacattagatgatggatataagtgtatggaagctaaattagagataatatctgcaagtgaagaaggatcggaaattagaattacaatacaagaaggtaaatttcatcaagtcaaaagaatgtttgaggctgttggaaagaaagttgtatatttaaaaagagaggaatttgggggactatcattagatgctgatttagaagaaggcgaatatagagaattatcagatgaagaattagccctattaaagagttattaacgaatgattaaaaaaaatgcaataaaaacattcattttaagcgaaaaaattaaatttttttaataaaatccttgcattatggaacgtaataatctataataatttgtgcaaggataaataaaaggaatatatagccccctttttatttattgcttattgcttattgctaaagcgcaacctagccccaagggttgcgtttttttatttcgtaaaatgaaaatgttttctattgattataatacatatttttaagtattatgtgtttaatttgtgaaaacaaaaaatgtcgaattatacctgcttcaaaagtaatggtgaaattcgtacaaaatgcaaaaaatcattcatatatattattatatgaatgattttttgcattttaactttacatgataagtaaaataatagaaaatacaaatgaattttatttatatggaaaggcaatattatttaagggatagattttatttagttaattacattttatttacatagatgagtgtgtgctttttataaggagattttatagcagacactttatatttatgtaattatgttataatatttaaggattgggaaaggaggaaaaagtaatgttagatttaaaaaacttacttaataaagaacaatatgaaggggcaactacaattgaaggtcaagtattgattttagcaggagcagggtcaggaaaaactagagttttaactcatagaattgctcatatggtagaggacttaaatattgcaccttataatattttagcaattacatttacaaataaggctgctaaggaaatgaaagacagagttagggcacttattggtgaatgtgctgaaaatatgtggatatctactttccattcaacatgtgtaaaaattttaagaagagaaatagataaaataggatataaatcaagttttactatatatgatagttctgatcagaagacattagtaaaagagtgtatgaaaactgttaatataaatgataaagatatatcggaacaagaaataattagtaaaatagggaaagctaaagatagaatgcaaactgcacgaagttttaagctagaaaatgaatcaaattttagagaaaacaaaatagctgatgtatatgaaatgtatcagaagagacttaaagaaaataatgctttagattttgatgatttaatatttaaaacagtagagttatttaagagtaatcctgaaacactggaattttatcaaagaaagtttaagtatattatggttgatgagtatcaggatacaaatggtgctcaatatgaactagttaagcttcttgcatctaaatacaaaaatatttgtgttgtaggggatgatgatcagtgcttagttgaaggaactatggtttctacagaaaataaagatgttgaaatagaaaagcttatgaaagaagatttagttagagttgcatcaggtaatggtgaaacttcattacttaaaataagtgatataaataagaaaaaatattgtggaaagatagtaaaaataactacaaaaaacaatagagttataaaagctacacctaatcatatttcatttgggaaaatatcattagaagaagataagtactatgtttacttaatgtacaaaagtgggtttggatatagaataggtcaaacttcatcagtaagatctagagacgatagagatgctagtggattagctataagattaaatggagaacaggctgataaaatgtggataatcaaagtttgtgacacaaaaggtgatgcaacttattatgaacagtattattcagtgaaatatggaataccaacaatagtatttaattcaagaggtagaaatataacaatctcacaagaacagatagaaaaaatgtttaaagaaattgatactataaatgcagctgagaagcttatggaagacgaattcttatataatgaatatccacatcatttgagtaatgcagtgataagaggagactctattagaaagagagttaatttaagcttttttggaggaaagaagtctgttcaaagagggatatattcacatagaataggacttaattcatcgggagatgactcaaaaaataaatttatagaagcaggatttaatgttagagatggtcaaagaaatacatatagagtagaaacggaaagagctttatatgatgaagctgaggaatttgcaagaaagcttagtatggtggaagagagttttgagattctaaaaaaggcaaagctttctaatgataagagttttatgtttatgcctataggaagttttaaaccaggaatgtctattgctatacaaaatagtgagaaaatagaagaggatattgtaatatctgttgaattagaagattatgatggatatgtatatgacttaaatattgataatgcacgaaactatattgcaaatggtattgtagttcataattgtatttatcaatggagaggggcagatataaaaaatatcttagattttgaaaaagattatcctgatgcaaaggtaataaaattagagcagaattatagatcgaaaggtaatatattaaatgctgccaatgtagttatagtcaacaactcaaatagaaagagtaaggctcttagaactgaacaggaattaggtagtaagataaaggtttatagagcttattcagatagcgatgaaggagactttgttggaaaacaaattttagatataagaaaaaatgaagataaaaagtataatgattttgcaatattatatagaactaatgctcagtcaagaatttttgaggaaagtttcagaagaaagggaattccttataaaattgtaggaggaactagattctatgatagaaaagaaattaaagatattctcgcttatttaaaagttcttataaatcctcaagatgatataagtataagaagaattattaatgttccaaagagaagtataggtgatgcaactgtaaataagattcaagattttgctgatagtttcgagttaaatatgtgggatgcattaagtgaagtaagaagtattccaacattaacacctagaaatgtatcatgtattgatccattcgttcaattgatggaaagcttaatgattttaagtgaaactactccagtttcaatgcttattgaaaccatattagaagatacaggatatatggatcagttaaaaaagtctaatgaaatagaagataagagtagaattgaaaacttaaaggaattagtatctgatgcagttgattttgaaaaaaatagtgaagataagtcattatcagcatatttagaaaaggtttctttggttcaagatacagataaaattgaagatgaagatgatagtgttgtacttatgacagtacatagtgctaaagggcttgaattcccagtagtatttatggttggtatggaaaatggtatatttccaggtagtgcttcatttgaaaaagaatcagaaatggaagaatcaagaagattatgttatgttggtataacaagagctaaagaaatactatttatgacttcagcagaggtaagaagagtatttggtaagacagtagcatattctcaatcagattttataaatgagataaaaccagacttaaaagaatatgtttcggtggaaaaaacaggaattaaaagtcgagagtcatttataaataaaagttcatataataatccacatagtttgagaaataatatgactagaacagtttctggaagtgggcttaatgcaagtagacctaattctattggatcttcttcaataggtaatgtatcttcaggtgattatatttcagttgcagaagctacaatgggaagaaaagtaatgcatgaaaaattcggagttggaactatagtatcagtccaaaattcaggagatgataaaaaacttactattgcctttgataaacaaggggtaaaagtcttgctattatcatttgcaaagcttaaaatgatataattaaatgtattaaaagtttaagatataagttaacaggtgatgagtaattttatagtattccatcatgctgttaacttgttaatttaaatagtaactttgtaatgagcataaaaatgtgacttgaatgatttattagaattaaaaaagaaattatacaagtttaggagaaaaagaagtggataagaaggaaaaaataaaagaattagttgaacagttaaacaattattcctataaatattatgttttagatgatccaagtgtaacagataaagaatatgataagatatatgatgaactaaaaaaattagaagaggaaacgggatttgtacttccttattcaccaactttaagagttggtgatatggttcttgatggatttgaaaaatatactcataaagcaaagctttggagtcttgataaggctcaatctattcaggagattatagattggcacaacagaaatgttaagtttgtaaatgatatgagattaaaaggtgaagatttgccagatttaaagtatgttctcacaaagaaatttgatggacttacaataaacttaacatataatgaagaaggagtaatggaaattgctgcaacaagaggaactggaaatattggtgaaaatgtaactgctcaggttaaaacaattaaatcaatacctctaaagattgaaaataatgatattcttgaagttcatggtgaagcagtgatgactcaggaagcattcgataaatataatgaaagtgcacaagttcctcttaaaaatttaagaaatggtgcagcaggagcacttagaaatcttaatgtaaaggaaactgcaagaagaaacctttctgcatttttttatgacattggttataaagaaggatctccttttaaaacatatttagaaatgctaaatttcataaaagaaaaaggtcttcctatggatgactatatgaaagtttgtactacaattgatgagatacaagaacaaattgattatataaatagtataagatttgatttaaattatgatatagacgggcttgtagttgcaattgatgatatgagaacaagagaacttatgggatatacagtaaaattccctaaatgggcaattgcttataagtttgaagctcaggaagctactacaaaacttcttggtgttgaatggaatgttggtagaagtggtagacttgcaccgacagctatattagaacctgtagaacttgcaggagttacagttaaaagagccactttaaataatatggatgatattgcaagaaaaggtgttaaaataggggcagatgtatttgttcgtagaagtaatgatgttatacctgaaataatgggaatagtacctgaaacattagatggtgcagaggatattaaaccacctaaagaatgtccggcatgtggaagccacattatactagatggagcacattatttctgtgaaaacacattatcatgtaaaccacagatggttaagagtatagttcattatgcatgtagagaagctatgaatattgcaggtttctctgaaagaacagctgaacagttatttgaaaagcttaatattaaatcaatttctgatttatataaattaaaagaagaagaacttattggtcttgaaaagtttggaccaaagaaggcgcagaatcttttagaagctattgaaaatagtaaggaatgtgaacttcatgcctttatatatgcacttggtattccaaatgtaggtgtgaaaactgctaaggacttagtaagtagattcaaatctatagaaggattaaagaatgctacatttgaagaattagttagtgttcctgatgttggggatattgttgctcaagatgttatgtcattctttaaagaagaaaaagttcttgaaactatagatgaattattagagcttggagttaatcctaagtttgaagaggttgaagtaactgaaaatctatttatgggaaaaacagtagtagcaacaggttcacttcagaattattcaagatcagaaataaaagaaaagttagaaagtcttggggcaaaggttgcaggaagtgtaagtaaaaagactgattatgtaattgcaggcgaagcagcaggttctaaacttacaaaagcacaggaacttggtgttaaagtactttcagaagaggagtttgaagaaatattaagggggtaaagttatgaaaaagttaataaatctgctatcttttggatcggcatttataactagcatattaataatttgcacatttttaacaacttatcagttttattatgttggtcaaatttttaattcatactttccgatacagttaggcgtttgtataactatggctattctgtcaattagatttctggttaatgaaagtggaagcaagagaatactttattcagcagtaagctttgctatagctgtatgtttactattcttcatgaatggtcttgttcgataagataagttaacttaaggtacaaatagtaaaaaaacaaattttatgataaaatttatctagttaacgattattagttaataatttaatgaaagaatcatgatgtgatttttgaaaataaacattttgcagtaaaatatatttttataaaatatcaaaataaatttatttagttagcagttaattaagttaaagtgaacagttaaattaataatattattgctaaaattttaattaaaaagttagcaataatattatcataactgttaatcgttaacttacaactgttaactataaagagggaggaatagaaatgtctgttagtgtaaaagatgttgaatatgttgctgaacttgcaagattaagctttgatgaaagtgaaaaagaaggtttagcagaagatctaaaccaaatattatcttatgttgaaaagcttggtgagttagatactgaaaatgaggatataatagttaatccatattatattgaaaataaatatagagaagatgtagtagtaccttcattagatcttaaggatgtaacttctaatgcacctgatacattagaagaatatgttatggttccaactataataaaaggatagtaattaaaggagggcaagtaaatggagttttcaaattataaagctcatgaattaaaagaaataatagctaaaaaagaagcttctgtagaagaagttacaaaggctcatttagataaaatagaaaatacagattctaaagttgatgcatttttatatgtagctaaggaagaagctctaattcaagcaaaagaattagatgaaaaattaagtaaaggtgaagatttaggagttctaggggagtacctttaggcgtaaaggacaatataagtgttaaaggaatgcaaaatacttgtgcttcaaaaatactagaaggatatatctcaccatatgattcaacagtttctgaaatgattaagtcagaaggtggagtaatcattggtaaattaaacatggatgaatttgcaatgggttcatcaactgaaaattcagcattcaaaaaaacaagaaatccatgggatttagatagagttccaggaggatcatcaggaggatcagcagcagcagttgcagctaaagaagtttcaatagctcttggaacagatacaggtggatctgtaagacagccagcatctttttgtggtattgttggtcttaagcctacatatggaagagtatcaagaaatggagttgtagcttatggttcaactttagatcaagttggtacacttggaagagatgttaaggactgtgcaatgcttactcaagctatagctggtatggataacagagactttacaacagcagacataaaggttcctaattattttgattctctaaatacaaatataaagggcaagaaaatagcagttccaactgaattctttaaagaaggattagatgaaaatgttaaaaaggctgtttatgatgcactaaaagtatttgaagcaaatggtgcagaagttaaagaagtttcacttccattagctgattatgctatttcagcttattacttagtagcatgtgctgaagcttcatcaaatttagctagatttgatggcgtaagatatggtaaaagagctaaagatattgaagattcagtagaattatacttcaaatcaagaagcgaaggattcggaaaagaagttaagaagagaataatgcttgggacatatgctttatcagcaggttactatgatgcatattataagaaagcattaaaggttagaaacttaataaaaggtgactttgataagatatttggtgaatttgatgcaataatatctcctacagcaccaactacagcatataaaattggtgaaaagacagataatgcattagaaatgtatttaggagatatctacactgttcctgtaaacattgcaggtattccagcaatttcacttccatgtggattagctgatggtcttccagtaggacttcaaataatgggtaactacttcagagaagatacattatttaatttagcatacagctatgaacaatcaactaattggcatgaaatgcatccgaatttatagggagaaggagtgaaaacaaatggaatttgaatcagtcattggattagaaacacacgtagaattatcaactaaaacaaaaatgtattgtggttgtgctattgaatttggtggaaaagcaaatactcatgtatgtccagtttgtttaggtcttccaggttcacttccacaattaaataaacatgttgttgaattaggaattaaagcaggtttagctttaaattgtgaaataactaaaataggaagaatggatagaaagaattatttctacccagattgtcctagaaattatcaaataactcaggatgaacttccactttgtagaaatggttatattgatattgaacttgaaagcggagaaacaagaagaattggaatagaaagaattcatatagaagatgatgctgctaagatattacatactaagagaggcgcattagttgactataacagagctggagttcctttaatagaagttgtaacaagaccagatttaagaactaaagaagaagttactttatacttaacaaaacttaagagcatactttcagcagcaggtatttcagactgtaaaatggaagaaggttctttaagatgtgatgttaatatttcagttagagaaaaaggcgatgaaaagcttggaacaagaactgaggtaaaaaatattaactcatttaagtctgtagaaaaagttttagaacatgaatttgaaagacaggttaaagctgtaactgaaggagaggatatgtttgttgaaacaagaagatgggatgaagcaaacaatctaactgtagttatgagaagtaaagaagaagcgaatgattacagatatttcccagaaggagatttagttactcttaacatttctgatgagtggattgaagaaataagaaaaactatacctgaacttccacatgaaaagcaagctagatttataagtgaatataagttaccaaagtatgattcagaagtacttacattaacaccggaaatggcagaattctttgatgaagctgctaaaatctcaggagatcctaaagcagcatctaactggatgatgggtgatgtttcaagacttatgaatattgatggaacttgggttaaagaacttaaatttgcacctaaggatatagctgagttaatagaggttattaaagatggaacaatatcatctgcaataggtaaacaggttgttgaagccatgtttgaaactggaaagtcacctaaagctataattgaagaaaaaggattaaaacagaacaatgatgaaagtgcaatccttgatatggttaataaagttttagatgaaaatccacaagttatagaacaattcaaagctggtagagatagaattcttggatttgctgttgggcaagtaatgaagatggctaaaggtcaggctaatcctggaatagttaataagctagttgaacaagaagttaaaaagagataatgaatgtataaataaaaggtattgccagaattatggtaataccttttgtttatattatttattaaatttttcttgtgtgcttaaatctgttatattatcaagattatcaatttcattatcagaaaactcgaaatcttcatctcctgttaaataagcatatttgttatctttatctgagttatcaatattatctgaaattaatgaaagcttttgacttattttttctaatatataattttgataacgtttctgtctataagacttaagatagacaacgaaactccatatacctataaacataaaaacacacatgaatactattgaaactattaaaaatgcacctgttaaaaattccatttcaaatacctcctaaaaagataaatttattatatcataaaatttgtaaataaatagattaatacaagcttttattatatattagcttggtttatttataaagttattgattaatatttcttaaaatcggcaagaatagtaataattatagtttatattacaagtatattctgttaataataaattgagcaaagggtgtaataatgaaaaaatatataatacttatcttaatcactattattatagtagcttttggaataagctttatagaatatgatgatagtagtgctgcaaatgttggattacaagaaggtattacatatggagttgaaagtattccaaatgatttaaagaatatatcagaactttcaagttcagataaaaatatattgtgtgcacttactaaaggtcttgttgagaaaaacaaggagggggagatagtaccttctttagcttctgaagttaataaaagtgaagatggtattcaatatgagtttaaaataagagatgatgtttattggagtgatggatcaaaagttactgggaaagatgttgtaactttttttaaagagttacttaaggaatgtaatgatgatgagataacatgtcttttacaagtatatggagccaaagattttagagatggaaaagttagttttgataaaggtgtagcaataaattgtagtgatgattctgtaacaataagattaaataacaaatatgatagatttttagaagaattatctaagccacaatatagacttagaagtaatattataatgtggaatgacattatgaaaaattataataatttattatattgcggtgattataaaattaaaagcgctgataagggtaatattactttagaaaagaataatgattcagtaaaatttaaacgaataagctttactaaagatgacagtgttgaactgtctatggcgtcatatgaagttaatgaaagagacatagttataaatcctccagaaagtgaattgaataaattaaaagactctaataagctaataacaatacaaaaaaattcaggagcatatattgttatgaacaattcatcaattcctatgcaggggcgaagaattgtatataattatatatataaagctataggattatatcaaagtaataatacttctgagtatgatttagctgaagggtgctattttagagaagaaaaagataatttaaatatgattcagcagaggaaagtggatagcagtaaagaaggtgagtggaatcaacctaaagtattgactttaatcgcagaagataataaaaaaaataaaattttatgtagaataattaaagaatggtttgctgctaatacaaacattacaattaaatatactttagctaacgatgatgagtttaaggattcggaattaaaaaagagatatgatgttattattgtgaataatgatgctatatcctcagaaaaagaagagttctattcaaggtttgaagaatatttatcagaagatgatttaaacatattagaaagtttgagaattaatgattattatggtgactaccatactcttgaagacagtctttttagtaactataatatattaccattggctttttataatgaaaatatagcaatttcagataaggtatcagatataagtattgatggtaatggtaatattgatttccatgggttaaattaaaataactaataaaaaatctgtgataattaatttttaatatcacagatttttttcatcatcttttctttgattttttactcttatttaattcagtagatgtgtctgaatgagtacttagtgagggtttattttttagattaagttcatgtgaattttcagatttttttagcttactgtcattaataggcaattcatcatcatctaataataagctttctttttttactacgcttacatctgaaatagtattaggatttttttctgacattatttctgcagttattgttttatctgaattagaatttgtattttcaatagctgtattagtaatatttaatttttcagattcataattagaatcattacttctgatgatcttattttcagaaggagtttttgtcataaatcccataaccttttttgcgttatctttaaggaaatatattaataaatagaaattaaacatatttttgctactatcaaaggatactttactactgcttaaaacatccttctttttagaatatgttagattttttaaaaatataggtgcgattccactactttttggcgtaggtagtacaggcattctgaagtatgtttcatctaacatatcatcggctctgagacttaaattcctatatctttcaatctcatctaaagttggagcatcaggccagcttgttaataatccattattaacaaagcattttctataaataccagatattatggattttaattcgatttctttatcatccatatctgaatacagaagaagagataaaagatacgaatttacttctgttgaagagtatttaacttcttttttatcagatagtttcataaatatattcttttctgaattatacatagttattaatctctcattaatttctgagtaacaatccttaaaagaaatcattcctgtatgtttataagcatccattagtgctatagaaaataatgcacagtcatctaacgaatctataaaataatctttttcttgaaatcttgttattaaataatcacctaaatcaattattaaattttcagcatcggcatcattagaatacttataataagcattcaagcataaaaatatttcaacattttcactaaatgataaatcataaagtgcatctttgtaatttataaataaatctaatatctctttcgagaattttaaataatcagggcttacttcatcagatggattatatttagagtataagagatatgcattcatcatatatgcctgatcagaaaatttaaatttatcatctttatctgctaaattaaaaccttttgaattaccatctgaagtatttttctttgtaacaaacaaaccttcattatttcgtaaattttcactatagaattgtaattgttcctttgcaatgtatttatacgcgtcttcaaaagaatctacatttctattttgattattatagtaagaataatattcacttaattctagaatacataaggtcataagagcattagttgatgggtttatttcctttttaaagcttgattcatcaaatccgtgacttgttttactgtggatgaataaaggtgaagcttttctatacatgcataatagtggagaaaaattatttaatatgctaatatcatttatagaagatttttttgaactccttacctgcattaaaagaccacattttgagtttagaactaaggtttttacagactcttttgataagtaaaaaagctgaccacttatttcatcctgagaaagactattcatcctgaaaaatggcccaatatatctcaatgtataacacctcttaaaaattcttgtcttattcattaatatgaggaaattagaaaaaacgtgcataaaatataaatacaaaggagatttttttatgaaagaaggaaaattagactttgatgatttgaagaaaattatatttaataataaaacaataaaaagagaagaagtaaaaattagaaatgatgtaggagaggactgcacagtaatagactttggagaatgtgaaggtattttttctacagatccaattacaggagctgataaaaatataggaaagcttgctgttcacataaattgtaatgacatagcatcatcaggtggtgagccattagggatgcttgttacaatattggcaccagtagattcaaccttagatgaaataaatgaagtcatgaaagaaatagatgaagaagcaactaaaataggagttgagatagttggtgggcatacagaagttacaagtgctgtaaataaacttgttatttcagttactgtaataggaaaaaacataaaaggaacttcggttaaaactggaggagccaagttaaatgatgatattgtagttacaaagactttaggaattgaaggtacttacattttaattaatgatcattatgagagagttaaagatattttaacagaagatgaaattaattttggaagaagattaatcgataatataagtgtacttaaagagggaagaatatgtagagagtttggagttaattctatgcacgatattacagaaggcgggcttcttggtggtatatttgaagttgctatggcatgtggtcaaggatttaaaatatataaagataaagttccagtattagatataactaaaaagatatgtgaggaatttaaaatagatccattaagattaatatcatcaggaagtatgctgattactacttgtaatggaggtaatttagttaaaaaattaaaagaacatggaattaatgctgaagtaataggtaaaatttgcgataaaaatactgtattaatagatgaaggaaaagaattggatgtagagcctccaaaaagagatgaattatttaatatacagtaattattttactttgtaatttttatttagagaaaaccatattgataaattatattaagattgagaggaagaatatgaaaaaattaattttagcaagtaataacaagaaaaaaataaaagaattaaaagatattttgagtgatataccagttgaggtaagatctttaagtgatgaaaatatagatatagaagttattgaagatggaaaaacttttgaagaaaatgctaagaaaaaagcaaaagaaatatatgaatttttaaaaaataaaggggaaaaaaattttatagttttatcagatgattctggtcttgaagtagactatttagatggggctcctggcgtttattctgcaagatatgcaggagaacatggcaatgactcaaagaataatgagaagcttttagagagtttaaatggagtttctaaagaaaaaagaggagctcaatttgtatgtcagattgctatatttgatgaaaatggaaaatattacactgtaaaaggagaagtaagaggatacatattagagcagcttaatggtgaaggtggatttggatatgatccattgttcttttacgaacctttaaataaaacttttggtatgttaaatccagaggaaaagaatgaaataagtcatagaggaaaagctttaaaagaattaaaaagtattatttcagaaacaataaaatagatatatttatggagggaatattatgagaattgctgttatcagtgacacacatagagctgataaatatattaacttagcaaaaagtttaattaaggatgcagatatactaattcatttaggagataatatagaagatgttgacaaattggctaatggatttaaggggaaggtgtatgcagtagcagggaactgcgatttttcttctaaatatcctaaagagggaatgattgaagttaatagagtaaagatattttatacacatggtgacctttatggcgtgaagagttctgtaactagtatctattatagaggtcgtgaattacaagctaatatagtgcttttcggacatacgcatcagcaacttatagagaaaacagaagaagtgatcctaatgaatccaggaagcatatctttacctcattttaaagggagatatgttggaattattgatattgatgatgatggaagtgtagatacatatttaagggaattaaaaatagggaattaaaagggttttaattttaattccgaagtataacatattaaactttataaagtatattttaagattataaaaagctaatttgtttttatacagattagctttttataattatagagtagattaactttatgagagaatgagtagaaatagttagtaagatttttgaatgttattatttttatatttattgatgattaaatgtattaagtttgaagtttatgtcaaagattatattatatagataaatataaaattaaaagtaagtataaaattaaaatgatttgttatgattttttaaagataaggagtagaatatagaaaaaataaggttagaaaagcctaatattacagggtttcaacaaaaaatcaaaaaaaattcaaaaaaggtattgacgaaatagatttgatattgtagaataatccttgtcgtcaggcactgaacggcaaagcaaaagaaagaaaagtcattaaccttcggggtgtggcgcagatgggagcgcgcgtgctttgggagcatgaggtcgcaggttcgatccctgtcaccccgaccattaatcttaatgattaaatttctttatgcgggtatcgtatatcggtaatactccagccttccaagctggaaaggtgggttcgattcccactacccgctccattaaaggttaaaaaaaccttgacaaaatttctaagaaggtttaaaataataaacgttctgaaaaatatgttgacaaaacattatgaaaagtttataatgaatgagtcgctaacatgcgtttttagctcagctggatagagcaacgcccttctaaggcgtgggccaggggttcgaatcccttaaaacgcaccatttaaatcggggtgtggcgcagatgggagcgcgcgtgctttgggagcatgaggtcgcaggttcgatccctgtcaccccgaccattaaatcttaataattaaatattatgcgggtatcgtatatcggtaatactccagccttccaagctggaaaggtgggttcgattcccactacccgctccatacaaacaaaagtttgtaacataaaatgcgtttttagctcagctggatagagcaacgcccttctaaggcgtgggccaggggttcgaatcccttaaaacgcaccattatggtgaatgtagttcagttggtagagcgccagtttgtggcactggttgtcgtgggttcgagtcccatcgttcaccccatattgggatgtcgccaagcggtaaggcaatggactttgactccattatgcgtaggttcgaatcctgccatcccagccatttatttaatacggttcactagctcagtcggtagagcacatgacttttaatcatggtgtcccgggttcgattcccgggtgagccaccaaatgtgcaggtgtggcggaattggcagacgcactagacttaggatctagcgccttcgggtgtaagagttcgactctcttcatctgcaccaaatgatgcgtgagtgactcaatggtagagtgccaccttgccaaggtggatgttgcgggttcgagtcccgtctcgcgctccatttaaaaagataatatagacaaactattatgcgggtatcgtatatcggtaatactccagccttccaagctggaaaggtgggttcgattcccactacccgctccattaaaccaaatatcatgcgggattagctcagttggtagagcacctgactcttaatcagggtgtccagggttcgaacccctgatctcgcaccaacaagaataattaccaaagcaaggattattacttggttacatattgggatgtcgccaagcggtaaggcaatggactttgactccattatgcgtaggttcgaatcctgccatcccagccatttatttaatatggttcactagctcagtcggtagagcacatgacttttaatcatggtgtcccgggttcgattcccgggtgagccaccaaatgcaggtgtggcggaattggcagacgcactagacttaggatctagcgccttcgggtgtaagagttcgactctcttcatctgcaccaaatgatgcgtgagtgactcaatggtagagtgccaccttgccaaggtggatgttgcgggttcgagtcccgtctcgcgctccatttaaaacagaagaaaaatatgcgggtatcgtatatcggtaatactccagccttccaagctggaaaggtgggttcgattcccactacccgctccattaaacaactgatttcagttgttttttattttatagaaatttaataagcacctatagctcagctggatagagcgttggacttcgaatccaagcgtcgcaggttcgactcctgttaggtgtaccaaaagaagtgatactaattgttatagaaatataactgttggtatcacttctttttttattatctcttgtaaattttaaaaattgcttaagtaatattaatttatttatctatatggacagtcgttagttttatatattttttgtgattaagtattagttcatgcgtgctttatttagggttttttatcatattaactttatattgtttaggcgatagatttgtttgctttttgaacatttgactaaaatatgatgaatttgaaaaaccaacaattgaacctatatctttaattgaataattagtagtttcaagaagacttttggcttctgtgattcttttttcaattagataggagatgggggacattcctatttgttttgtaaaagcatggactaaactaaatttattcatgtatgagagatttgataaagtttccaaggttatgttttctgagtaatgagaatctaaataattttttattttcgcacattccaaatttagattctttttttcattttgaagtatggacattgaagggatggttcttaatatgttaaggataaatagagaaagcatacttttgcaagcaacttcatatttataatttttaagtttaatttcatcgattattagatttaattgattgagtataatagaactatttttttttagattaattacatgataatttttagaatcagattgtgaaaatttttcattatttaaattaaagaaatttatagagaaattatcaatccctaaaactatatattcgagaggagaagtatttaaatttgatttttctgtatgaagacaatttggatttattattatcaaatcatattctttaacattgacagtgctatcttctaactgaaacgaaccatttccttctgtaatgaaaaatatctccatgaatggatgaatatgagctgtgctatgccaatcattttcgaattttgattttgttatatagagtaattcaaaattaaaatcagagaaatttttatcatcaattaaatatcttatatttcccataatacccccattagttcatagattaaatgaccgtatattctatatttattaatagtttatatataattattatactatacggatgattaaagtaaattaatattatagcaatataactaaagaatataacaacaatcttgttgtgcaaatgattacaaagtaatatcataagcatatagggaatggagggagaaacgtgaataataaaggtaacaagacatttattactttatctttagtaccagcgactatactgttttttatatttataattataccaacaatgaatgtattttggatgtctctgtttaaatggggaggacttgtaaataataagaaatttgttgggttagataattttataatgttatttaaagacagtaactttttaaaatcatttcaaaatacaatttttctattagttatagtaactattattactatggcattagccataatatcagcagcaatattagtcaaagaagatacaaaatttaaaaacttcttcagaataatattttactttcctaatatcttatctgtagttgtaatctcagcaatattttcagcaattcttgatcctaatcagggaatagtaaattctacattaaatttctttaatttaaattctttaactcgaatgtggcttggagatcaaaaagttgtaatatggtgtattgcatttgctatgatatggcaggccattggatattatatggttatgtacatgtcaagtataagcggaatttctataagcttatatgaatcagctagtttagatggtgcaacaggaatacagcaattttttaagataacgttgccattagtttggaataccataaggactactttaactttttttgtaataagtacaataaatttaagtttcttatttgtaaaagtaatgacatctggtggaccagatggatcttcagaagtatttctgagttatatgtacaagcaggcttatagtaattcttcttatggatatggtatgacaattggtgttgtagtatttatattctcatttatcttatcattggctataaacaagataactcaaagagatataatagagttttaagaggtgaattttatgaatgataataaattacaaaagaaattagtgaaattttttatgtatttttgcttatgggcttttgcactaagtataatagttccgcttggatgggcatttttagcatcattaaagcataaaacagaattttatggaaatccatgggcattacctaaaggattatatctagaaaattttagaaaagcttttgtagaagcaaatatgggagaatattttttgaattctgtatgtataacagccttagctctaattatattacttttagtgtctataccagctgcttatgtattagctagatttgaatttaaaggtaagaaaatagtaagtggtttatttacagcaggattatttgtaaatgtaaattatatagtagtaccaatatttttattaatacttgatggtgaaaaatttattaagaatgtttttgcaataccgttaagtgtcacagtatttttagatagcagaatagtggtaagcatagtttatgcagcaacatcaataccatttactgtgtatttattaataaattattttagaacactatctaaatcatatgaagaagctgcttatattgatggatgcagcaagttaaaaacattaattcatgtaatcataccaatggctaaaccaagcataattacagttatattatttaattttttagctttttggaatgaatatataatagcattaacacttttaccaaatagttcaaaaacgctaccattaggactcataaatttaatgcaagtacaaaagacggcaactgattatggtgctatgtatgctggacttgttattgttatgattccaacaataattttatatattttagttcaaaagaaattaacagaaggaatgacagttggcggtgtcaaagaataaggaggaaaaaatgaataaaggaagagtaactattccaacagatgataattttataaaagaaacatgtgaaatattagaaaagtggggagcagatgcaattagagattgtgatggatttaagttaacaccagaaattgaaggtttagcagaaaaaatatattcaacatattttgtaagtcgtggagataataaatgggcagaagagcacatggatgaacttcaacagacgtatttaatgagtaaatataatttggcaaccagtaatgtattggaaatatcaattatggatggatattttgaagagcaaattcagccggatataaaaaatgatattaaagaattctgggaagtcatagatagaactacaaatgaagttgttagcacagataattgggattataacaaagatgaacaaaaggttataataaaagatgctaaaatgtggcatgaatatacagtttcgtttttagcatattgtatatgggatccaactcaaatgtataaccatataactaatgattggaaggataaaccacatgatattccttttgatataagaaatgaaaacacgaatatgcacataattgaagctatgcataattggttagataatcatcctggaactagtgtagtcaggtttacaacatttttttatcacttcactttggtatttaataatctaagaaaagagaaatatgttgattggtttggatattcttcaagtgtaagtgcaaaggcattaaaagaattccaaaaagaaaagggttacaaattaagagcagaagatattatagatgaaggttattataattcaacgtttagagtacctaaaaaagcatatttagattatatggattttcaacagaagtttgttgcagaaaatgttaagaaattagtggatatagttcatgagaatggtagagaagcaatgatgtttttaggagatacatggattggaactgaaccttatggaaaatattttaaagatataggattagatgcagtggtaggatcagttgggaatggtgcaactcttagaatgatatctgacataccgggagttaaatatacagaaggacgttttttaccatacttctttcctgatactttctttgaaggaaatgatcctattatagaagctagagaaaactggcttacagcaagaagagcaataatgagaaaaccagtagataggataggttatggtggatatttatcattagcatataaattccctgattttgtaaagtacattggaagtgtatgtgatgaatttagagaaatatatgacaatataaacaatgttaaaccacattgtggattaaaagttgccatattaaattgttgggggaaacttagaacttggcaaactcatatggtagcacattcactttggtataaacaaatatatacttatcttggagttatagaagctttaagtggaatgagctttgatgtagaatttataagttttgatgatataaaggaatatggaatatctagtgatatagatgtaataataaatgctggagatgcaggaactgcatttagtggtggagaaaagtggattaatgaaaaaataagtactaccttaagagaatggatttttaatggcggtggatttgtaggcattggagaaccatcagcaattttaaatggtggaagattttttcaaatggcagatgtacttggtgtagataaggaattaggattttcattaagttcagataaatatttcaagacaaaacttgaaaagcattttataactgaggatgtaaattcaaaatttgattttggagaaagtattaaaaatatatatgctaattctgaaagtacagaaataatagaaatacaaaatgatgatgtattgatgtctgctaattcatatggaaaaggtagagcagtgtatattgcagggcttccatattcagcacagaatgctaggttattaatgaggtcatgttattatgcagcaaacaaagaagagcatttaaaagaatggtattgtgacaatatttattgtgaagtgtcagcctatatagaatctaataaatatgctgttattaataattctaatgagaaacaaaaaacaaatgtatatgatggttttaaaaatatatttgaagtagatttagaaccagcagagataagatggtttgaaataaaataaatccttgttttataggagatgattgcatgaaaaagataatatattcaataatttttattataagtttagctttagtcataaaaggcagaacgataacgaatttctatgggcttataatgatgtttcttggattgataggaatactatcagaaatatacttatataacaagcaatacagataatgatggtcaaataatatttaataaataatactaatcagtttaaaatctaaaaaataggaggtatttagaatgaaaatgagaattatatcaacaatgttagcatcattgatgatggcttcaggactaattgggtgtggaagtactactgaggtatcgaaaagtaaagatgaggcaaatgtattgaaaatagctgcatttgaaggtgggtatggaaaggtctattgggaaaaattaaaagaaaactttgaaaaaagtcatgaaggtgttaaagttgaacttacagtagcttcgaatttagaagaagtaattcgtccacaaatacaatcaggaaatataccggatttagtttatttagcaactggaagaccagatgcgttaacagagacttttataaaagatcaaagtttaagtgatttaacaggattacttaataaaaaaataccaggtgaggatgttacagttaaagaaaaaattttaccgggatttttagatacctcagctactaacccatataaagatggaaaaacatatttagctcctttattttatagtcctactggattattctatgataaacatttatttaaagaaaaaggatacgaagttcctaaaacttgggatgaaatgtttgctcttggagataaagctaaaaatgatgggttatcattatttacttattcaacaagtggatattttgattgcacagttccagcgttacttgctgcttcaggtggcttagatttagttaatgatgcttataattacaaagaaggtacttggacatcaaaagaagctaaacaagctttagatgttgttggaaaacttaaaaattatttagaaccatcagttgttgcgaatgcaaataatcaaggatttacaaaaaatcaacaattaattttagacgataaagcattattcataccaaatggtacttggcttccagatgaaatgaaagatgcaccacgaactgaaggttttgaatggggatttatgccatatccagcatttgaaagtggaaaagatcaatattcagtaagttttcttgaacagatgtatattcctaaagatgcagctaataaagaattagcagaagattttatggcttatatgtatagtgatgaggctgttaaaattatagctgaaaatgcaaaagcagttgtaccagttaaaggagctgttgaaatagctaatgagtatttaaatccattacaagtagaattatttaaaatatatgacaatggtgcattacctattatgggtggattcgtagctactaatgcagttgaaggtgttagctggacagatgtttatcttggaactatagattctataatgtctggaaataaaacagtagaagagtgggaaaaatcacttgaagagacaagtggtaaattgagagaagctataattaaataaagttaaataaaaagggaatatattatattccttttttattgaagaaaagaaaggggtataattatgtattttttaggcgtagatggtggaggaactaaaactaaatatttattaatagataaagaattaaaagttatagaagaaatagaaagtggtacaacacatattcatcaaataggaaaagaaaaattaatacaggttttaaatgaaaatttacaattaatttgtgaaaagagtagtataaataaaagcgaaattgaatatgcatttttaggtatacctggatatggggaaagtaaaagtgatattgaagatattgatcattcagttaatgaagtttttaatggaattaattattctattggaaatgattctgttgttggatgggctgctggaacaggttgcagagagggggtaaatattgttgctggaacaggaagtatagcgtatggaagaaataaagaaggaaatgaagctagatgcggtggatggggaccaggcattggtgatgacgcaagtgcatattggattggactaaaggtattaaatgaatatacaaagcagaaagatgggagaagggaaaagactgtcttagttgatatattagaagaaaaatacgatattaaagaatattttgaaattgttgatatagtattcaataggcttaagttttctagaacccatatagctaaattttcagaaatagcttacttagcagcagctgctggatgtgatgtttgtataaatatattcaaagaggcagctaaagaattattttttcatattaaagtacttaagaaggaattaaatttagctgatgggtttttagtgtcttatagtggtggagtatttaaatctggagattttatactaaatcatttaaaagaaatgttgaaaaataataatatagattgtgaattaatagaaccgaagcttaaaccgtggcatggagctgcattgttagcttatttattatcagataatgaattaccagagaattatatagaattaataaaatagagatatgcagaaataatctgcatatctctattttttatgcattaaaaatagatttcccattaataaatacttgtttaacatctatattttcatcgaataatactaagtctgcgtcgtatccttcttttattagtcctttatgatctgatacattacaatatttagctgggttgtaagtagccattttaacaacttcatataaaggcatattacagttgttataaacattctttatagctctatctagtgttaaaactgatccagctaatgatcctgttttgattcttgcagcattatctttaactattacatcttgtcctccaagtgtataattaccatctggcatacagcaagccatcatagcatctgttactaaaatagactggtcagagcctttttgtttgtaagcaattcttaatgctggataagaaatatgaattccatctgaaattgtttctattgttattttatcattatcaaatagtgcacctataattcctgggaatctatgattgaatggtggcattgcattataaaggtgggtacaatggttagcacctacatctatggcttttattgtttcttcatatgtagcttttgtatgtcctaatgagcaattaatatttttatgagataaatatttgataagatctaagcttccgtctaattctggtgctaatgttattgatacaacagcatcttcacattcagcggtcattttgttaaatatatctatagatggggtttggagatattttggattttgagcacctattgcagatgggtttataaaaggtccttctaaatgggcacctagtacttgggcaccagaagttccattttcttttaatttctttattgaacgcattgatttgtttatgtcttcaatagaaactgtcattgttgttggaagaaaagaagttgtaccatgtttgactattgtttttgatatggaatcaatagcgtcaacagttccgtccattgtatcatatcctccagcaccgtgaatgtgtatatctataaatcctggtgacaggaataagccatttgcatcaataacttcatcaaattcacaattttttggatttaattcttgtatttttccatctttaataagaacagaccctaattcgatatgatctagtttaattattttacaattttttattaacatgttatatcactccaattatatatatttaaataatagtattggtattatccaattgtatatttttattataaaacatgtacaatgatgttttcaagaaaaaaatcaaattttataaataagatgaagaaaatatttagatatgattaaaaatcaagtaaatacagttatgtaacggtaatattagattatgactaaatgaaaaaatataaaaaaaatttatgaaaaggttgacatttaataaaaacggatataaaattaacttgtaaattggttaataccaaaatgaaagaagggaatggttttatgcctaatattttattaacaagaattgataatcgacttgtacatggacaagtaggagtaacttgggtgaatcatttaggtgctaatttaattgtagttgcaaatgatgaagtttctaaagattcggtacaacaaaacttaatggaaatggtaataccagatgccataggaattagatttttttctatacaaaagacaattgatgtgattcataaggcatcaccaagacaaaagatttttctagtggtaagaaatccacaagatgctttaaggttagcggaaggcaatgtaccaatggacaagataaatataggaaacatgcatttttcagaaggtaaggaacaaatttcatcaacagtttcaattgatgagaatgataaagaagcatttagaaaattaaaacaactaggaatagcattagaaataagaagagtaccagacgaaaatattgacgaagatatttataaacatatttaaaaatgaaaattaattttaaggaggaaactttatgtttgtacaagcactattaataggtatatgggctggtatagcaggtgtggatatgtttgacggactaacacatattcatagaccaatagtaacaggacttgtagtaggattaattttaggagatatgaaaactggacttatagttggagcatcacttgaacttgtttggatgggtatggtaccacttgcaggagctcagccaccaaatgttgttataggaggaattataggaactagtatagctatattaggtaaattagatgctcaagcagctattggtatagctgtaccatttgctgtagcagttcaagctgcaataacattactatttactgctttttctttctttatgcataaagcggacaagtattgtgaagaagctgatacagctggaattgaaagaataaattatttgggactagtagtactatttgtattctattttactatagctttcttaccaatattattaggtgccgataaggcagcagcaattgtaggtgcaataccaacatggataattgatggattatcagtagccggtggagtaatgccagcaataggttttgcaatgttgttaaagataatgttaaagaaagaatatattgcatttatgattttaggatttttattagtaacatatttcaacttaccgattttaggacttgcattattgggagtatgtattgctttatatgattatttttcaaaaagtaatagtaattcaaaagaaaaagtggtagaggaggtatatgatgatggaatctaatacttataaagacccttcaaaggaaaaggttattactaaaggtgatttaaacaagatggtatggcgttcgctacttttgcaagcatcatttaattatgaaagaatgcaagcttgtggttggttgtatggactattaccaggtttaaaaaagattcataaaaataaagaggatctttctaattcaatgaaagataatatggagttttttaacacacatccatttttagttaatttcataatgggtttaatacttgcaatggaagaaaataaagaggatagaaatacaataagagctgtaaaggtagctacaatgggaccacttggtggtataggtgatgcattattttggctaactgcgcttcctatatgtgtaggtattggtgcttcaattgctatggaaggaaatatagcagggccatttgtattcttaatcttatttaattcattacactttttcttaagatttttcttaatgaaatatggatataataccggtgttaatgcaatagctacactaaaagagcaaacaaagaaaatttcgcatgcagcatcaattgttggtttaacagttgttggtggtctaatagcttcaatggtaaagttaaaaactacaatggtaattgcagttggttcagcagttggagattcagctgttaaggttcaagaaggtgttttagatgctgtaatgcctaacatgctagcacttggatatacattattaatgtataagctattaaagaagggatattcaccagttaagttaataacaattacagttgttatgggaatactagctaaagcaattcaacaatttacaggattcgctatattataaaatactatcttggattggtatggttgagctgcaaaattggtattgatttaaaacttagaaaaatgatatatttattactatacaatgatatgagaaagtaggaaatatattaaagaattggagcgtgaccataccatgaaagaaaaaatagataagaattcaaaaataccattatatatacaattagctgatatttttattgaaaatattgaaaaaaatatgaatgaaaatgacaaattagatacagaaagagagattagcaagcagtattctttaagtagagtaactgttaggcaggctcttgattaccttcaaaagaatggatatatatataaaattcaaggtaaaggaaattttgtttgtgaacgaacaatggaacaaaatttaacgaaattttattctttctctgaagatatgagaaagaaaggaaagattccaactacagaaatattaacatttgaaattgtggaggtagatgaaaaaatagcatcgaaattaaaattaaaggaaaatgatttggtatacaaaatagctagaattagattagctgattcaatacctatgatatatgagatatcgtatcttccgtataagagatttgaagatttaaataagaagatgctagaagaaagttctatgtatgatgttttcaataaaaattatcataccaaaataacatatgcagaagaattgtttagaccaattttagtaaacaaacttgaaagtatatatttaaagataaaagaaggggaatgtgctttaaaagtagagagacttacctatgaaaatcaacaaataattgaatatacagtaagtattactagaggagataaatttaaatatagagtttgcttaataaatgattctgacaatattgaatgaagaaataggaaaatataaataaagaattaataaatttataagttgtaatttttatatgtgtttaaattataacttataaattaaaggtgaggagaataaatatgatttttggaaaaagcttagaagaactagaaaaaataaaagctatattcacagcaacagaaataagacagcagccagaactctggagggaaacttataaattaatattagatcaaaaagaagctatgcaaagatttataaataaaaatgtagataagaatacaagaattgtattaactggagcaggaacatctgattatgttggcgatacagttgctttagaattaaataaaaaattagaagctaaggttgaggcaattgcaacaacagatatagtatcaaatccaaatgaatatatagaaaaaaatgttaaaacaatattagtttcttatgctagatcagggaattctccagaaagtataggtgcatatgatttatttgaaaataatattgatgatataactcaaattgtaataacatgcaacaaagatggagatttagctaaaagatgtgtaaataatgagaaaaacatgttggttttaatgcctgaaaaatctaatgataagagttttgcgatgacaagttcttttagttgtatgacacttgcaacattgcttatttttgatatagaaaatatagaaaaaaataaagaatttgtggaaatagtttcatcacaagcagaagaaatattagataatagatggtctgaaataaagcaattggttgattatgaagcagaaagagttgtgtatttaggttctggaacacttaaaggattatgtcaggagatggcattaaaaaatcttgaacttacaagtggacaagtaactacaatatgtgaatcagtattgggatttagacatggacctaaatcaataattaatgataaaaccttagtgataattatggctacaaatgaagaatatacaaaattatatgatattgatttgataaaagaaattcataatgatttaggaaatcataaacttgcagtaattacctatgaaaatgatgaaattatgaaagaaaattgtagcaactatatatgtgtaaatggaaaaactatacctaatatatataaaatttttaattatatgatatttggtcaaatgtttggatatttaagttcactaaaacttaatatatctccagataatccaagacccgatggaactgtgaatagagttgttaaaggtgttgtaattcatcaatataaatagaataaggagttaacacatatggtaggaataatagtatcaggtcatggaaattttgcttcaggtttattgagcacattgaaattaatcgcaggtgaacaagaaaatgttgtgggcatagattttatagatggacaaggatctgatgaattaaaaaacaatattaaggaagctataaataactttgaagatgaggtttttatattaactgatttagctggaggatctccatttacaaattcggttcttttaaaacaagaattaactgataaaaacatagaagttatatctggaactaacatacctatgctattagaagtagtacttggaagagataatgtggaactgaaagatttaataaaaacagcaacagaagctggtactaaaggaataaatatttttgaactaaaagaaaaacaacatgaggatgataatcttgatgatggaatttaaatttattaaaaattataaattctagtaagaagggagcaatttacaatgatattatcaacaagagaaatgcttttaaaagcacaacgtgaaggttatgcagtacctgcgtttaatattcacaatatggaaacattacaagtggtagctgaaacagctatggaaatgaaatcgcctgtaattatagcaggaacaccttcaacaatagaggattatgcggggcctgattatattaaagctatggctgaagtagcggcaaataaatatgatattccaatagctatacatttagatcattttgaagatgtagaggcaataaagagggatattgatataggatttaaatcatgtatgatagacgcttcgaaaaagccttttgaagaaaatatatcaattgttaaagatgttgtagaatatgcacacagatatgatgcggttgtagaagctgaacttggaaaacttggtggaaaagaagatgatttagtagttgatgagaaagatgcaatgtatactaatccggatgatgcagcagaatttgttgataaaacaaatgttgattcattggcaatagcaataggaactgcacatggattatataaaggagagccaaagcttgattttgaaagattgaaagaaataagaagtaaagtgagcattccgttggttttacatggagcttctgatgttcctgatgaattagttaaagaagctatttctcttgggatatgtaaagtaaatgttgcaacagacttaaagattccctttgctgatgcagtaaaaaaattctttaatgaaaactcaaaagaaagtgatccgagaaaatatatgacaccaggtaaagaagctatgaaagaaatagttaaacataagattgaagtatgtggaagcgctaatagatattaaatgagaaaatagcttaggaaatgctccaacaaatcctaagctgacaatagtgatttattacttagaatatctaaataataaaaataaataagcaactataattttataataaaagaaaatcaaatacaatagtagtaaatttcttatataattgtaatatacatgacattaataaagcgtaggtcataatccctacgctttaattgtaaatataaatagtaagtgaaggtaaaagtgatgaggatgcatatattaatcttttaaaatgaagatgtaaatgtgatacgctatttatatattattaggaaataatgaataaattaatgtgaagagtttgatgatataataacttttgtcatactattttcagtataaactaatattttagtaaaaagttattgacaagattatattcaatgatataaaataatttacgttacagaagcaaaaggtaacaaagtaacatgcgtttttagctcagctggatagagcaacgcccttctaaggcgtgggccaggggttcgaatcccttaaaacgcaccatttaaaatataatataaaatgcgggtatcgtatatcggtaatactccagccttccaagctggaaaggtgggttcgattcccactacccgctccattaaacaactgattttagttgtttttttattttttatataaaagtataaaatatagtatcgtagaggatttatatattttaccactaataattatagtagtgtgtattaaatagaagtaagttcttaattataattatttaaacttaacttgttgattaaataattatataaatgatatttttatataaatatcattacagtattgacaaatagattttatgtagagtataataattaaagaagaaagacatattttgataaaatattatatgcgggtatcgtatatcggtaatactctagccttccaagctggaaaggtgggttcgattcccactacccgctccaattgaacaactggtaacagttgtttttttattatataaaagtttatttattgaatataatttggagagtgtttttatacggtaaaataaagttttttgtagaaacatagaaaatgtgtataaaaattagaagtgaaagtttaattttaaaactttttattaaagttatatatataaaattaataaaaagatagcgttatatggctgttataggtttttttatagctgaattataaaaataaatcaataaatatcgaaaaaaataaaaaaactttgaaaattgtgttgacattgtccaaaatatgcgatacaataatcaacgttgcaggaacaaaaacagcaacagcgttacaagaggtaacgtcaaataaatgcgtttttagctcagctggatagagcaacgcccttctaaggcgtgggccaggggttcgaatcccttaaaacgcaccattatggtgaatgtagttcagttggtagagcgccagtttgtggcactggttgtcgtgggttcgagtcccatcgttcaccccatgttgggatgtcgccaagcggtaaggcaatggactttgactccattatgcgtaggttcgaatcctgccatcccagccatttaattttttggttcactagctcagtcggtagagcacatgacttttaatcatggtgtcccgggttcgattcccgggtgagccaccaatcttataaaagattcaaaatacctgttttatttttatgataaaacaggtattttttgtttatctaaaaatcttcattttgaaaataaaaaatgtaagttagaaataacatatgaaataacgggaattagagaagtattcattaatattttcttataagaattaatttaatttaagttctatgtattatttgtactccttaacagaataataaaagtagatagtaaataagctttattatagaagtaaagggatgaacatatgaagaattataaattcacaaaaagattaacaagctttatgttattaataacaattctattacaatcgtttaacttaaaaatatttcaggtaaatgcgttagcagcagaaaatattactaaatcagatatttcagagatacggttagaagatgatttttatacagctattaatagggaatggttagaaaatactaaacttgaaaatggttatatttcttatggtacatttgaagaactatgtggaagagttaatggtgagatttataacattatacaagaaataaaagaacatagaaaatgttatggagagaatagtgagcaattaaaattattgaatttgtacagcaactttttagatatgaaaaagagaaataagatgggcataaaacctattgaaaattatatgaaaaatatagataaaataaaaactttagatgaacttagaaatatattttatgaagaagagtttacatattttcagccactaattaatattggggtaggtgcagactataaagacagcaatatgaatgtactttattttggaagcagtaatttagttcttggtaattccttatattataagagcgaatcttatgaaaatataaggaaagaatatataaaatatattgaaaaattacacaggctatatggagaggacaagaaaaaatctagagagaatgctgaaaggttttataatatagaaagaaaaattgcagaaggtattccaacatatcaggaagaggcaaaagataataatcgatttaacaacacttataatataatgacagttaaagagctagaagacatttcgcctaatataaaaattggagagatgctaaaaaaattcaatataataaatcctaaaaaaattatagttgagaatcctagtaacatacgatttgttgattcattggtaaatgaagataatttagaagatatgaaaattttttttaaaactatagtattgttaaatactgataatttacttactaacgattttagaaaagctagctcagatttaaagaaagagctttatggagtagaagttgttgatttaacagaaagtggtgctgtgaaatttgcaacctgtaatctatgtgaaattacaagcaaattatatgtagataaatattttgataaagaatgtaaagatgaagtaagcactctttgtgatgaaataattgataattatagatatagattgaataatgttgaatggatgacagaagaaactaaagaaaaggctttagaaaaacttgataatatgaatgtcaaaataggatatccagatagttggggagaatataacgatttaaaggttaggtcattttcagaaggcggatcattggttgagaatattattaatatatatgaatttcagacaagaaagcagtttgaaaaaatagatatgcccgtaaataaaaaagaatggagtatgggagcgtgtactgttaatgcatactataacccactaaataatgaaatagtatttccagcagctattttacaatatcctttctatgataagaatgctagtaaggaaaaaaacttaggaggaataggagctgttattgggcatgaacttactcatgcatttgataatgtgggatcacaatttgatgaagatggccaattaaatgattggtggacagaaagtgattataaagagtttactgaaaaaagtaaaaaagttattgattattattctaatattgaagttgaaaatggaaaatttgttaatggagctttaactgttggagaaaatataagtgatttaggggaatagcgtgtgtaattgatattgcaaaaaaaatagatggatataatttaaaagatttatttgaaaattatgcagcaatatggagagaagtttccacaactgaaataaaagattatttattgaataatgatcctcatgcgcctaaaaaggttagagttaatggagttttatctcaatttgaagaattttataaaacttatggtataaaacctggtgataaaatgtatgtaaagcctgaagatagagttggaatatggtaaaaagatagaaaggagaagtttaattggtggaataatagttaaacttctcctagtgtatctatatatcaataaaatagtataagagagaatattgaagaaaaattagaataaatttaataaataaggttatattacattttaggcatttcttattatgatagaataaatcttgtcgctgcgagagttgatgaaaaaacacgaaagaatatgaaaaaagattcaaaaaaagtgttgacagaaatttaagtagatgataagataaataagtcgtttgaagcgacaagatctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaataccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattacaacttgctcaaaggttacttaatgagtattgattctgttcaattttgaggatttcttcaagaatatatgggcttatagctcagctggttagagcgcacgcctgataagcgtgaggtcgatggttcgagtcatttaagccaccatattgttctttgaaaattgcatattaataatgtataaatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctaggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgatggggaaggttctacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatttggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcaagttgtaatatacaattaatatgcaattttgaaagaacaatagttttttcaataatgttccgcgatagctcaatggtggagcactcggctgttaaccgataggttggaggttcgagtcctcttcgcggagccattttttttatgaaaataaatttgaaattattcagtcgagaaatcggctttttttttgtgaaaaattaatgtactaaatatactgttatagttttcttaagaattgtaaaattaccaatataattgatactatatagaggttatacgtaaataatggctaataatttaacattatttgaaggtatattactaattacctaaattttcactaagaaataagcctataattcatatttttattattgtaaaaaacagagatagtacttatacttaattagggggatgaaattactatatttattctaaatttagtagttaataatcctttttagatataaatgttgtgtggggtataaaaatgaggtacaaaccaagacgtaacaaaaataaggcaaaaaatatttataaaacaaaaataattattttatgtacgagtatagctcttttagtaattgcaggtagtgcagtaatggctcagagatttatttcatatatagatactgtacaagcaaaagacgatcagattgttttaaatgataagaacaataacaaggacaatgataatggagattcagataataaaaattctaatcaggtaagttcagagaattctgatataccacatgatagtccagaatttgttcaaaaatatttagatcagcaaatgaaaggtcaaatgccagatggtgctgatggtgttaaagttgtatatcttacttttgatgatggaccatcagaaactgtcacacctcagattttagatgttcttaaatctgagaatgtacatggaactttttttgttcttggaaaagctgttgattcaagcgctgagaataaggaacttataaaaagaactatttcagaaggtaatgctataggtattcacagttattcacataattataattatttatatccaaataaaattgttaatgtggataactttaaaggcgaagtagaaagaactgatgcatctttgaaaaaggtattaggagatgatttttctactaaggctataaggcttccagggggtcatatgacatggaagggtacagaacctttagataaatattttaaagaaaatggatacagttatattgactggaatgcattatctaaagatgcagaaggtcctaaaaaaaatgctgatcaattagttcaacaagtaattgaaacatctggaaataaacaaaaagttgttttattgatgcatgatacttatggtaaagaagaaacagctaaatcattaactaatataattcgtcattttaaagataatggatatgaatttagagttataaaataattataaacactaaaaaatgtttatgtttctatatatttatatagattacataagcatttttaatttttttaatataagtttactataagcgtattgattagagtgcctaatggggactctattttttatctactgaattattttgttttattatgtgcaaaactttttatatagtataaatcgtctattaaatagaaataaataatttatattttgttttgctgggattgttaatttaaaagtttaaaatattgattaatgttttatgaaagattgataaaactaaaataaaggaggtataaaagtgcttgcaattttaaaaagaaaaaaagtggaaaaatatataatagaaaatagagagtattattatagattagcttattcttatgtgaaaaatgaagctgattcactggatgttatacaagaatcaattattaaagctctaatttcaattgaaagtttgaaggaaatagaaaaagtaaaatcatggttttataagatagttattagaacaagtattgactatataagaaagaataaaaaatataatgatatgatagatatttctgaaattataaataatggtaagtcagatcaatataagaacttagatttatataaagcattagatgaattagatgaaacatataaaacaattataattttaagatactttgaagatatgaagataaatgatattgccgatatattagatgaaaatccaaatacagttaagacaagattatatgcagggttaaaaaaattaaaaatagatataggggagtgttagttttatgaaaaatataaatgatttaaaaaaggaatatatggatataaaaattcctgaaaatcttgatgatgttgtaaaagagtcaataaaaaaagtcgatagaaaaagcatagttaataaaaaaattataggttcagccgcagtattagcaattatatttggaataaatataagtccagcattcgcagatgtagtttcagatattcctattgtaggtaatatagtgaaattagttacagttaaaaattatacattaaagaaaaataatgttgaagcagatataaaagtaccagcaatagaaggtttggaaaataagcaattagaggaaaatcttaataaagaattcattgaaaatggtaaaaaaatctatgaagaactaatagaagaatttccatcaataaataatcaaatgaagtatgtaggttctgactataaaataaaagcagataatgatagcttcttatcaatagaaataactaaagaagaaattcaggcatcatcatatacaactaaaaagcattatacaatagataaaaataagcaaattgtacttacattacctatgttgtttgaaggtgagaattatattgaagagataagtaatgatataaaggctcaaatgatagagaatatgaaaaaagacagtaatttaatatattttctagaatctgatgaaaacgaagaagttatagactcttttgataagataaaagaaaatcaggatttctatataaataatgatggaaatcttgttatatgttttgatgaatatgaagttgctccaggttatatgggtactttagaatttataatttcagataaaatatttaaaaaatagaatagttatatttagaatttatcttttagatttaaaattttaataacaaataataatagagtgagtgtgtctttatactcactctattattatttaattttaaatattttatgaaataaatttaatgaagaaaattaggtcttcattaaatgatagaattaatactttaaaaacttaggtattctctattgatgaacttaatattataattattaatatgagtaaaataataaactgacaattacataaacttatatattgtattagtttatgattaaattttatttaaataagtatctatgaaaacatcaatagttacgatactcatagaaaatagatttatttcaattaagtataataaataataaaaaaattataaggaggagtttcatgttatctaaaaatatcgtttcacaagttttagctaaatgcttaataacaggaggagactttgcagaaatatttgaagatgattcaattaataattctatatcattagtggatggtaaggttcaggatgctataggggaagaagttatggtataggaataagaatctttaagggattaaaaagtgtttatgcatatacaaataataatagcttaaatagtcttttagaaacagcatatagagctgctctagcattaggtgatgtaaaagaagaaaagagcattgtgttgtcagagaaaaaaatagagacaatacatccgatactttattatcctaaagatgtacaatatgaaagaaaaatatcaatattaaagagtgcatacaacggagctaagaattataatagtgatatttcacaagttatatcaagctattctgataaagaacagagtatattaatagccaatacagatggattatatgttgaggataaaagaataagaacaagattaggagtaagtgctgtagcatctaaggagaatgaaaatcagactggatttcaaggtccaggaagacacatgggaattgagatgtttgaaactattgatgcagaagctgcaggaatagaagcagcgagaatagctcatacaatgcttcatgcaaaaaattgcccagcaggtaatatgactgtagcaattgataatgggtttggaggtgtaatattccatgaagcatgcgggcatgcattggaagctacagctgttgcaaaaggaaattcagtttttgcaggaaaattaggtcaaaagatagcatcttcaaaggttacagcaattgatgatggaactattcctaatgcatggggatctttaaatattgatgatgagggaagtaaaacacagaaaaatgtattaatagaaaatggtattttaaagggatatatgatagataagcttaatggaagacgtatgaatatggagcctacaggaagttcaagaagacaaagttataaatatcaacctacatcaagaatgactaatacttatattgcagcaggaacagataaaccagaagatataataaaatctattgataatggattatatgccaaaaaacttggtggtggttctgtaaatcctgtaacaggtgaatttaacttttcagttcaagaaggatatcttgttaaaaatggtgtaattcaagaaccagtaagaggtgcaagtcttataggtaaaggtagtgatgttcttatggaaatagatatggttggagataatttagaactagctcaaggtgtttgtggatcatcttcaggaagtattccaactaatgtagggcagccaatgataagagtaaagaatataactgtaggaggtagataataatggattttaaattatttaaagaagaactttttaaggaagcaaaaaaatctggttttgaagaatgcgaaatttattattcagatgctgaaagtttaaacataaatatttatgagggtgaagttgaaaaatataagcttaatactgcatttgggctttcttttagaggaatgtttaatggtaaaatgggatattcttatactgaaatattagatgaagaagctattaacacagttattagcaatgctaaaagtgctgcattagcaatagaaaatgatgatacacaatttatttatgaaggtgataaagaatataaaaaattagattgttataaggaagagcttgataatgtgaaaccagatgaacttataaaacttgcacttgaaatggaagaacaatgtaaaaagcagtgtgataaagttgtgaatttttctggatgtggaattggttatggaaaatcaacttatggaatagtaaatagtaagggactaaatttaaaaaatgaaagaaatcatctcacagcttatgttattcctataattgaggataatgatcagaaatatgatggaatgggatatgttgtagcagaaaaaataagtgatgtaaatccagaaaatatagcaaaagatggacttaatgaagcattatcaagagttggtggtagaagtatcagttctggaaaatataaaataataattaacaatgaggctatggtttctcttcttggaacttttgactcaatattcgatgctgagcaagctcagaagggattatctcttttaaaggggaaagaaggagaagttatagcatctaatgttgtaaatctaattgatgatccacatttaaaggatggattaggaacaacagcttttgatgatgaaggagttgctacttatagaaaggaaattataagtagtggtaaattaaatacattgctctataatttaaaaacagcgaataaggcaggggttaagtcgacagggaatggattcaaggggtcttacgcttcaattgtaggaataagtgctactaatttttatatagaaccaggaaataaatcttttgatgaactttgtgaagaagttaaagatggagtaataataactgaatttgctggattgcatgcaggtgcaagctctgtaacaggagatttttcattagcagctaaaggtttcatgattgaaaatggtaaaaagacattccctgtggaacagataacagttgcaggaaatttctttacactacttaaggatattgaaactgtaggaagtgatttgaaatttcctatgagcagtattggatcaccatcagtaattgtaaaagaattatctgttgcaggaaagtaatataaatggaaagactataaatgcttgatttaaaaatcatagtatttatagtcctttatttatgtatatgcttatagagaaaaacaattttaataaattataagttttgattttttacttacattatctaggtgaaaatcaccaatagcatcattaaaattaacatttacattttctgttgaaggataaaaataaattagaaatccatcacagagacttaaatcatattgagcagcaaattgattgcaaatattatttaaattctgtgaagatgtatcttctacagaaacatcaaatctgaaaaatttatttccaaatgttattttctttattgtaaatggtatgtttttatcaatgttagtatcaaattttccagaaaaggaataatctaagtttactgcattactactaacaagagcagtaggcttataggatgtattcggcataaaattcttaattggtagagagagagtatcagttactgtttgagaagaatcagtaaatgtaagcttaatttcaccattaaagatactatctgaattattgttaatagtcatttcagcattcttatttgtactacttcctaatgaatataatttatattggaagtttaaatcatcaattgaagcttcagtaactttaatttctttatcaataggctgggttgaaagttgtgtttccacttgctcaaaagaggattctttcttgaaaaatgttattccagttccagcagatattagaattattgataaaagaaaaactattcccacaaggtttaaagaagatttagcacctcttttaattgcaaaaacaattaataaaagagatattataattccaacaacacctataaggtaaaggattattgggagtaaattcatttaaatcaccactaactttaaaatattataatataatgtataattatattatatattgaaattttaaagacttaaagtatatgaaatataaaaaaagaaaaaattacatggaggtatgataaatgccaagttatgatttgattataataggagcaggaattgcaggaatgacagctgcattaggtgctgctagacaaggaataggtaaaattttagtaattgaaaaagaatcgtcagttggaggaataataaatcaatgtattcacaatggatttggtaagaagttaataggcgaatatgttactggtccagagtatattcaatacataaaagatgaaattcagaaagaaaatatagaaattattcttaattctaatgttttagatattaatagagatagagtagtaacatacgttagtccaagtgaaggagtgaaagaagtaaatgcgaaagcaattatttttgcaatgggtgcaagagaaaagtattcaggaaatataatgatttctactaatactttaacaggaatatttactgtaggagaggcacagagaatagttaatcttgatggatatattccagggaaaaatgcgataataacagcaaaagatagatggggatttcttctggcaagaagattacttatcgaaggtggatcagtgtcagcagttgttcttgaagatagttttaaaaatgttgaaagtaaagaaataaatgatattatagatgggtttggaatatcaataatagagaaatctagaataattggcatagaaggaaatacaagaataaattcagtaaaattattaaatttagaagatggaagcacaataaataaagaatgtgattgcttattactttcagttggttttataccagaaaccgtaagaataaaaaaattaaatatagagattgatgaaagaactttaggtcctaaagttaatgattatatgacttctacagatggtttttttgcatgtgggaatatagtatatggagaagatgtacttaagatatctgaaattgatggtattgaatgtggggaaaaagcagcatcatatataaaaaaatatttttcataatataaagagttttagaataacattatagcagtaaaaatactagttaagtatttttactgcttctttatacataatattatttccttcagaagatagatgtaatccatcaatatacaaatcctgggttaattcaagactgtagaaatcgattatgtcagttttatatttatgagaaagtaatattaaagaatctcttaattgagtaaggcttttttcagcatagctataaaaagaagatggaataaataactcatttgccattgatcctattattttaggaggaattcctataataactttagcatttatattataagaatcttgaatcattatttctatattttcaataatagatgagatgcttcttccacatagaagatcattagttccgcccataataaatattgtatgtggattatattttaatgcatctgaataaaatcttgaaagcatagaaggtgtagtatcaccattttttccattattaatataacttaaattaagcttattggctatgaggtatacctatgatttttcttttgaaacgccatatccaaatgtaaggctatctccaaaaaagataatgtcaatatgattattcatttaatatcctccttttatcaaaacaattttccaaaacactttttacatattattgtttttccaccgtcagcttttatacaattgtttggatctgtaattttattgcatatactacagagcttatcattatcattggatgcttgtttttttgatgaatttaaagaagtatccttattcttaataatactcttttttataggggaatataattttggattacaaggtatatcttttttagtaatattataattaaagttatattgactttcagcaaatagttctaattcaaagcgaggattatctttatcataatattcttcagtgaagattttagttatctgcgcatcattcacaattaagccacttttttctataccatcaaagatacttttagtaatattaatagtatcagggtgtcttttgtcacttttataatatacttttaagatagcaatgaggctttcagaaaaaacaatatcaggattttgacttcttgcaagaagagctatttcttgttcgtataaagcatatctatcatgatacttaccagaattatcaggaagtattgcacgtccattaatattatgtaatttaaaatttgatttagtaataggtgatccttttaccactactttagcgtaatctgtcattttatatctccttaaaagataaatttcttataattaaaactatacagtatattattatgttatacaataatgaaaaattgataatattgtatatataaagtataatatttggggattattaagattaatgtaagaattaaatatattcaatttgatataataatttacagttactaatgtatatagtaataatatttatttgactttttatcaaacaaaatttgcttaatttgtaatttacttaatgttattagtttgttaataaagttttaataaataatgtaggataagtttaaaatttgtaatatacaattaattatagtaatttgatactttatataacataaagatataagaagaggtataaagatggataagaagataattttatcaatagaatcaagctgtgatgagacatcagcagcagttgtagttaacggaagagaagttttatctaatgtaattgcatctcaaatagatacacataaaaagtatggaggtgtagttcctgaagtagcatcgagaatgcatatagaagtagttgatagtgttgttaaagctgcacttgatgaagcaggacttaaattagatgatattgatgcaataggagtaacgtacggtccaggcttagtaggagcattacttgttggacttcaatatgcaaaaggattagcattaggttcaaataaaccattaataccagtaaatcatatacaaggtcatatttgtgctaattttattcaacataaggatttaaagccaccgtttgtttcattagttgtatctggaggacatacattcattgtgcatgtaaaatcatatagagaatttgaagttataggacagacaagagatgatgcagctggagaagcttatgataaagtagccagggcactaggtcttggatatcctggaggtcctaaaattgataagttagctaaagaaggaaatgaaaatgctatagagtttccaagagctaaattccatgatgatacattagatttttcttttagtggagtgaaatcagcagttttaaactatttaaacaaagcaaagatgaaggatgaagaaataaataaagcagatattgcagcttcgttccagaaagctattgttgatgttttaaaaaataatgtgtttttaacatgtgaaagaagaaaactaaagaaaattgctgtggcaggaggagttgcttcgaactcatgtttaagagaaactctaataaaagaaggagctaaaagaggtatagaaatattattcccagaaccaatattatgtacagataatgcggcaatgattgggagtgctgcttactttaagttcatggatggttcagaatctgatttaaatattaatgcaaagcctaatctaaaattagcggaggggtaatttatattatgaaattattatctcattctaatggattgtataaactagataaagaaaaagtaagtaagataaaaatattaaaaagatgcgctatttttttagtaggattgttagctataggttttttaatacagagtataggtaatttaattgataattcgaaactaaaatcacgtttcaaatatgtaagacttgatggtaaaaaaattgagtataaacttaaaggaagcggagaatatacaataatttttgatggatcaataggaactaatttatatgagtgggataaagtaagcaagattttagaagaggaagataaggtttcaacttttgtttataacagaagaggatatggatttaatgatggtggagcacgattaagtccagaagaacaggcaaaacaattaaagttattgttaagaaaagctggtgcagcagagccatatattttagttggtgaggaatatggaagtttaatttctactaattttgctaatctatatccagaatcagtagcaggggttgtacttgttaatccaattaatgaaagtgatttatttcaaaaagaaacaaataaacagattttaattccatatttaagaagtcaaatagaatatgctggttcaaatgtttccttaacatcattactagataagatgaatcttacattaaataattcaacttttataaatagtttaagtggaagtgaattagaggaattcaatagttttaaaaatagaaaaaattatacggaagcagtaaaaaatgaaatagaaaatttatataaaaacacatcaaatagtcaaagtgatggattgctttcaaaaaaacctctttatattataagtaataatgagagtgaaccattaatgaagctaggaaattctgaaatatcaacattatacgtagagactgttgaagaagaaccatttgcagttgtagatcctgatagtgtagtaaatggaattaatactgtaattaaacaggcaaaaaaattggcaaaaagttcttaaattctaaaaatttattgtcatgtgtttgacacaaaaagcttatatactaacaatataaaataaataataaataattttaatatatataaaattattgtttaggaggaatagcacatgattaatgatgaaaataataactatattgatgtagaatcatcaccagttaatgataatggttcaaatgtatttgataatcaatttaaatatgaagacggaaatatttcaaagaaaaaaagaagaagaggaatcttaggaagagttgcaggatgtcttttacttacagttacaggaggattatttggaggaggaattacatattctcttattaaaaataatgtcaatggtggaaatggactgtcaataaataaacaagtaaattatgtacctcaatcttttactgaaagtgattcacaagcgatgacagctgctgatgcgttcaataaagtatctccagcagttgtaattatttcaactgtaggtactgcatcaaatggttttacagcaagtcaatatgaaggtatgggttcaggatttattataaatgaagaaggatatatattaaccaactatcatgtaatagaaggcgcaaaggatattacagttacattaagtgatggaaatgaagttccaggaacagttgttaactatgaccaagaaaaagacttagccatgattaaattaaaagaaggtacaaaagttcctgctgttgcagagcttggtgattctgatgaattatatccaggagctgaagtaatagcaataggaacaccactttctaagaatttagcatatactcttacaaaaggtataataagtggaaatgatagaactatacaaactcaaagtggaacaagtgtacatttacttcaaacagatgctgctataaattctggtaatagtggcggaccattagtaaatactaaaggtcaagtaataggaattaattccatgaaacttggttcacaatcaactggttcggctacagttgaaggaatcggttttgcaattcctataaatgaagttaagagtaaaatagatactttatcaaaacaaattctaaacttaggaataaaaataagagaaattgatagtactactgctcaaaaatatgatttagaacaaggtttatatgttgcttcagttgatgaatattcaccagctgaaaaaggcggacttaaaattggtgatataattgtagattgtgatggaaaaccagtaaagacatttgatgagcttaaggaaattaagcaaagtaaagatgttggtgatacaatgactatgaaagtcataagagataaaaagactattgatttaagtattgttttagaagaatcaaaataattattaaaaaatagaaataaataaggcaaatagaagcattagtaaaatgcttctatttttttacagtaaaatcttttaaattaaataaaagaatagtaaaataattattataatggaattggggaagatgaaatatggaagaaatagtattaagtataataatgcatagtggcgaagctagaagctattccatggaagctattagactagctaaagaaggaaattttgaaaaagctatggacttaataagaatggccgatgaagaattaggctatgcccatagttcacaaacgagtttaattcagggagaagcagccaatgatcaaattaaattttcattgcttcttgtacatgctcaagatcatttgatgacaacaatgacttttaaagatatggcagtagaattgatagaagttcatgaaaaattatataaactagaagataaaaaataaatataaatttgtcatatctgcacattttacttcttactttcataatttattatataactaactcatggaggtaaagataatgagcggaagagtaagtatgtgttctatatgtcctagagaaaatgagcagattgatgcagttattcaaataggaagagaaaacagaagttgtttatatggtactattattgatgaatgtggaaaaccagtagttgacgcagtagttaaattattaaaagtttgcgataaaggaataattccattaactcacacatttactgattgttatggacaatttttgctaggtcctttatgtcctaatgaaaaatatatgttaaagatatacaaagataatatcagaataagatatgagcctattaatgcatcatgctacaagggaaaatgtattggtgaaagatgcgacgacgaagaatgctaatatatgtttaattagggtagtttaattaagataaaaagttctcttttatagagaactttttatgttatacttattattaagtgtattgtaaggcagttataaattaaaagtaggtgttttgatgaagaataaaattaaatatggaatagcctttatgattattttattaattggaattataagtattaatatatatcagcctaataaagagcaaactcttaggggtaagattgagataatagcttatgatgatgtatatgattatttagttgaatgtgcagataaatttatggaattaaatgataaaacaacagtaactgtaaaaaaaatatatagttcagatgaaatactacaagaattaaataataaagacaatagcagagtgacatctattgctcaaattaatagaatggattttgatattttaggattaaaaaaatcaaactatttagaagaacagcagaatattttaaatacatattctaagaatttttcaacatatagactacaacaaacagaatatgatgatatttctgttggtattccatttacttcaagacctttagcgctatatataagagaagatatgttagaagagtacgggtataatagggatgaaatgaacacttgggatgatgtaattagaattggtaaagatatttttgaaaaaagcaatggaaatgtaagaataataaatgctactggagacgattatgaagatttagtatctttattaataatgcaatatatggggaaagaaaataatgaagaattggtaaaaaaccaagtaaataacatgatggatcagttaaagaataataacatattgaatttaactgaaggtggagagttcttaggaagaatatcatcaattaatgctgttaaagaaattgttgcactagatgtgaaatgccaatggacagcagagaatgtaccatcaattactcatggaactaataagttcttttctagtgaaggtgataattttgttgtacttaatgatatagtagaaaatagaaaattagtagaaaaatttataacttacgtaatgactaataattctgaagctatagaatatgttgcacaaggaagatttttttcaagttatttatatacttataaaaacaaagatagtgaagttcagctaaataattttattggaatgagtcctatggttgtattaagtaatgttgaagaaaagacacgtccaattagtaattatgaagagtatataaatattaaaaagacaatattaaataaataacataataaaaaataaagaaataagcatattatttattagcttatttctttattttttataaaagattttttatagtgaattaactattgattcatatgcatttaatgttttttgcgcagttttttcccaagtaaaattaaggctattctcgtatcctcgttgagaaagctcttctcttagtgttttatcatttaataattttacaagagcattttcaagttgtatttcatcatatggatttattaaaatagaagcatctcctgtgacttcaggaattgaagttatattagatgttataacaggagccttacagctcattgcttccaatggaggaagtccaaagccttcatatagtgaggggtatacaaaagcatcacagccactatataaaataggaagaacatcttcttctaagtatccacaaaatacaattttatcagataaattattactttttacatagtcaaaaagtttttcaccttcatcttttaaggatccaccaagtaataaagtatatggagtttttaaactcttataacagtttttaaatgcctttattaaaccaagggcattttttctagaactgaaacctcctatatacaatatataaggagtgtttacattatatgttttatttacaaaaagttttgattcggttttgtctaaaggtttaaattttgaattagctgctagaggagtaacgtatattttttcttctggataaaaactaaaaaattttagaatatctttttttgaatattcagatacggtcagtatgcctgctgagtttgaaacaatattaggcatatcttttaaaaaacgttccaaatatcctttaccaacagtctcaggcattaaatacggtattaaatcatggattgtaaccactgtagggagatccatatcataattaagaccaattccattttgaggtatatgatatagatcaatattagagtttttcactttgtttggaaaataatatttctcataaaagcttccatgacgtcctgaagaaaatattatttcagtgttgtttttattaaaattttcattaaggcttccggaacaaaataataagaatttattgtacgagttaatattaatcatattagtaattaaattattagtgtatgttccaattccagtaccgttatataaataagcacctcttgcgtctatggcaattttcatatgaacacctctataaacacatatatacttataggatattaaaactgatacctttttgtgattataaggatttgatttttattaataaatcacaataaattatttaatgacatataataagacaaataatactaattgggaatttttatgaatgatagtaataatacaattaaaatcaaaaaatttattgaggaaaattatgatctgactgtagaaaaagtagaaaaggttaaaaacagttataaagtaattacttcacatggaacatattctttgaaaactattaaatatgaatttcctcatttctattttattttatctgcaatgaaacatctacaggaaaatggatttactgatatgcctgaatttattttaaataatagagaaaaagaatttggattaatggataaaaaatatgtttacttaactgaatggattccatcaagattaagtaattttgataatccaattgaactttcacttgtagctacagaacttgcaaaattgcataaatcaagctgtggttttaatgttacagaaaaaatgaaagcgagaattggatggttttcatgggaggaagtttttgaaacaaggaaaaatgaaatacttgattttcgaaacaggatatatcaaaaggcatataaatcagattttgatttattatatttagataatataaattcagaaataaaaagagcagagaaaagtattgagggattgaaaaaaaataattatatcaaggtgatggaaaaggagatttttagaagaggattttgtcatcatgattatgctcatcataatatattagtagataatagaggtaaattcaaaataattgattttgattattgcatattagattcccatttacatgatgtttcatcactatttataagatcaatgaaagatggaaagtggagtgacagaaaagctgatgtgattttatactcatatgaaaagatatttgaaatagaaaaaaatgaattacctataatgagagaatttataagatttccacaagccttttggcagattggcttacaagtatattgggagcaacaaccttggggagaagaattttttttgaacaagctaaaaagatatctagaggattgtgatgagagagaggaatttattgattcttattttaaagggggagattaaaataaatgaattgtcactcaatgaatatttagaatcaaaaggaataattgtaatgggaaagtatttttctcatacaaaagattttacaagaaagtcatgtgagaatcagataagtactatggttgaacttcataagttgttaataaactgcaagttcaataatttaaataggtttggaagtgttataggtaaagaacttgaatcttttaaggtacaattaaaaaaaatagagagagattataatatattatttgagaagaattcaaaaaataatgttgaaaaattatttctatcagaagggaagagaatgattcttcaaggtagagaagctgtagaatatatctgtaataatggatatcttgatattataaaaaggagcatgaacagggaagaaatatgtataggaagagctgatagtggaaatttgagaaaagtaaatgggaattttgaaattggtataattaaaggcatatcttataatctagttgaagaagacttatacaaatatattaaaagaatacagaaaaaaggaattaaaatagatgaagaagagtttataaggttttttgtacatcaatctcatttatctttaagcagcattaattatcttaaaggtctgtgcacttatcctaaggatttctttaaaacttgggagcgatataaggaaaataaaaagaataagagtgaggatgaatttttagatcttttaagtaaaagtttaaaatatgaaagtagaaagtttatctgatgtctatcatatgtaatactcaaaatattttgagtatagaacatagttatgctactaaataagatgcaccttaagcatgttgtttaactaatacgtatagtggattaaatccaaccttaatcaagttttacttgatagatcatgtgcacatgtccattatgaaatatggagggaattgaatgaatagaataaagtattcagaaaaagagtacttgtgtgattatgatttgagtttgaatttttttaatgcggcaggtataaaagttaatgatataattcctttgagaaaagtttttgttttatcaacagatgaaggaaataaaatacttaaaaaagtaaattatagtgttgaaaaaatagaatttataagtgaatcattagattacttaaagaagaagtataaaaatataatcagctacaataaattaaaaaataatttaaactatataaagtggaaggatgatatttatatagttatggatatactggatggaagagaggcatcgttttcgaaccctgtagaaattgaattatgtgcaaataatatagctcttatgcataatgcatcaaaaggacttattgcttatttaaatgataaatataataaagattttatagatgattcgtttaaaattaaaattaagaaggcattagatgaacttgaatacatgaaaagtattgcatcaagatataaatataaaaatgaatttgataacttgtttttagataatgtagataagtatattgatgatataaaatatgttgaagaggatttagataagagttcatatgataatttaagaaaaaattatgataatattactatatgtcataacgatcttgcatatcataattttctaatcaaaaattcagaagttagcattatagattttgattatatgactttagatttaagagtttgtgatatttctgattttttattaaaagcaataaaaaattctgcatttgatatggataaaatgatattggcaattgattcttatgaaaagtcaagtatattgatgaaagaagaaaaagaattaatatatatatatttgaaatttccaaaagatttttattcaataactagggattattattttaagcgtaaaaagtgggactatgatgtttatttaaataggctatgcaataaacttgataatgatttttttagacaagaatttatgaatgagtataaaaaaatgatattatgattaatataaaagcgttcaaaaaattgaacgcttttaatatttttatccccttctatgttttaaacatagaaggggatattttaaatattaataaaattatattggaataaaataaaaataagtatatttttattttataattaataactaaattaatgattagttattaattattgattcatatgaatgaagtgtttcaagagctgtctttttccatgaaaatttactgcttctggtaaggctcttttttaccattgttaattttagaaggctattgcttaaaactctttcaatatcatatgaaagtaaatcaatgtcatgtggatctattaataaagctgattcataacatacttcaggcaaagatgttacattagaggcgattacaggagttccacaagccattgcttctacaggtggaagaccaaatccttcatagaaagaaggataaacaaggacttcagcagcattatagaataaaggcatatcttctaatggaatgaaatcagtaaaaattaccttatcatcaacatttagatgttctgctcttaatttatatttttcatatgagggaccttttctgcctattataacaagtttaaatgtttccttaatgttttcaggaagttttgaataagcttctataagtccaataatattttttctagggctaaatccaccaacgtaaagaacaaaatcttcttcaatgccatattttcttgtgactaattcttttgattgtgatttgctaagaggtttatatatatcttcggctgctagtggtgttacatatatattatcaagaggaaaattaaactctttagcaatgtcatttttagaaaactcagaaactgtaataattccattacagttgtctaaaattttaggaagttcattattaaatattcttaagtatctgtcacttactgtttcaggcattcttaaaggaattatatcatgaagagttattacttttttacatgatatattgtcggaaagtcctactccattctgaggaacatgataaagttcaatatctgaatcctttaaaatattaggaactttaatatcatcccaaaagctattagaacttattgaatcaactgtttccagtttgaaatttggttttaagttagaaagtgaatcacaaggggcataaatatcaaataatcatttgtactgtcaacgctgtttaggttacgaataagttcatgtgtatatgttcctattcctgtaccacgataccattttgcagctctgccatctattcctactttcatttcgaaatccttccatagcatttatcatattgtattatattaaaagaacataaaaaatgttaataaaagaataaatatccacatataaatatacaggaggtgagaactatgatgagggagtttgaaatagaaagacagtttaatattaagatagaaaaaattaaagccaataaaggtgtatactatcttaagactgataagggcgaaaggtgtttaaaaaaaataaattacgggcctcaaaagttgctctttgtgtatggtgctaaggagcatttaagaaaaaatggctttagtaatttagataaatattatttgaacatagatggagaaccttatgctttagtaaacgaagacttatatactttatcagaatggttagatggaaaagagtgtgattttcacaatatagaagaggtgaaaatagcagcaaaaacattggctaatcttcatgaagcatcaaaggggtacgatccacctgaaaattcaaaattaaagagtgatcttggtagatggcctcatttaatggaaaaaagaataaaatcattagataagatgcgtgatatggtaagaaagaaaaatataaaaaatgattttgatcttatttatattcagtcgatggaattttataaagagattgggaaaaaggctttgcagacactgaaagagtctgattattatgagctttgtatggcagcggaaaatgaaaaaagtttctgtcatcatgattttacttatcacaatataataataggcgaaaataaagatgtgcatgtaatagattttgattactgcaaaagagaagtacgtacttttgatataagtaatttcatgataaaagtattgaaaagagtagaatggaattttgattttgcggtagctataatagatacttataattcagtttcaaagcttaaagatgaagaatataaagttctatattcttatcttcaatttccacaaagatattggagattagcaaacagatattattataatgaagtcaactggggccagaacacttttgctggtaagttaagttcaataataaatgaacaggaaaaatatcttcaattcttggataaatttaaaaaccattataaactatgatatattttaaaaatccttattgatgttttaattagtattatcaataaggatttttatttagtgatttaattataatttagtgaaactttttcatattataatccatattataaaaatatactaataataacatatggagaaaataatgaaaataggagatatagtggttagaaaatcttatggaagagatattacatttaaagttatagatgtaagagaaaagaacggaagagaaaacattatattaaagggaataaatataagaataattgctgattcaacaatagatgatttggagccagcagaagaggaggacagtggtactcaagataagattttgaatactagggttagtgaagctataaataaggctataagtatacgtggtgtttttagggataaggcagaaaagtcacctaaaataaaaaataaagatgaacttgtatttggaagacctggtaaaatacttcatgttgatggagatagcgattatatggaaacatgtttaaaagtttataaacaactatatttagatgcagtcggtaaatcaattccagaaagtgaacaaccaggtgttatagttgatcttgtaaaagaaataaaaccagatattgtggtattaacaggtcatgatagtgttataaaagatcctaaagattatcttgatttaaataattatagaaattctaaatattatttagaatctgtgaaaaatttaaggaattataattctagctatgatgagcttgtgatttttgcaggagcatgtcaaagctgctatgagagaattttagatgttggtgctaattttgcatcatcaccaaatcgagttttgattcattgtttagatcctgtttttgtatgtgaaaaaattgcatatacaagaattgataaagttgtttctataacagatgttatagaaaacacaataacaggaattaaaggggttggaggattacagacaagagggaaatatagagaaggctatcccaaatcatcatatatttagattaaaattatgaaaatataaaattaggtaaaagtcatataatataaaactgagaacaaataaattaaatttaaagttttattatatgacttttatatattaaagaaattattcagtaaattggaataaaaaacaaaaaaatagagaataatagaatgactttaaaataaaaatttaacatatattttatttttattgacaactaatattgtacgtgataaaatatttgttttgcttgacaaaattaggaattacatgtataatttacaatggaaagagggtgtttgtatggaaaaagtaaaaacaattgcttccataaaaaacgacattgagcagcatataggagagaaagtaactcttaaagctaatggtggaagaaaaaaagttttagtcaatgacggaataatagacagtgtatatcctagtattttcgttattagattaaaatgtgacacccaaaggactgtgacatatagttattcagacgtattaacaaagactgtacaattggtatttccagctacaatataaacttcgatttatcgaagtttttttttataaaaatttgcataaaaaaaagaaagatggtgggtttccatctttcaactatggtataaaagggtattgagaatttatgagaggttatatggtcaataaccaattactatattacgacaaaatataataattgtcaataaaaaaactgaaaaaaatttcaaatttcagataatataaagaaatatgtatatttaccggggattgtgcactatttaaaaacattttagaatatgaaaatctgtatttatatagatataaaaattaataaattaaattagttattaattatcataaagtttgaaaataaagtatataaatagatagtagaaattttatggaggtagaaagtatgtcagatatagatgttataaaagaaaatgttcaatttgagcagcttataagggaaagcaactctaactgtgtattaaaggatgaatatttaattccagatactcacccggatgttcaggaaatattaacagttgaatcaagaccaatgataactagcaaggaagttgttggagataaaatcgtacttgatggaaaagtagaatatactgttttatatttggctagagaagaagggcttataattaattcagtaaattatactcagaaatttactagtaatattgatcttaatcaagatgaacataaggttatttgtgaagcagaatgcaaagtagaacatattgaagctgcaatcatgaatgaaagaaaaatattgatacaggggatatttgatattgattgggagctttataaaacaaatgaatttgaatttgttaaagaaattgaaggaaatgatgaggtagaagttttaaagaaaacagaaacaataaatagaataagtgcaaataaggaaatcgagttaacaggaaaatctgtaataagggtaggtatggataaaccacaaataagtaaaatacttaactgtggattattgcttcataagaaagaggttaaaatagtcgacgataagatatatttaggatgctactgcaagttaaatatattatataagggtgatgatacaaaggatatagtatgtatggaagatgatatatatttatccaaggaagaagaaataccaggaataacagcagatatgataccatcagtttcatttgagatactagatgatgagcttatgcttgaagaagatgatttaggtgaagtaagagtaataaataatgaattgactgttaaagctaacataaaaatattttctcaagataaaattgatacaattaaagatgcttattgcccaaattcaattattggattgaaaaaagaagaatatgaagtaggggttttacagggagctaattcttcagaaactgttgtaaaggataatatacaattaactgatactgatttaaagccagatcaaataatatactcaaatgccactataatattaactgataaagaaataatgacagatagaattgtagttgaaggaataataaaagcagacgtgctatataaaacaactgatgaagaaaaaaatatatcagatataaaagctgagataccattttcatctgcacttgatatttctggagcatctgagggtatgaagtctataatacgagcagctgttgaaaatattgatgctgcaattgaaggaaatagtatcgctattaaagttaatgttatattaagtggaaagataatggatgagttaactaaagagtttatttatgatgttgtggaagaagagggagaaaaaccagagaaaaaagctagtataacaatatatgttgttgatgaaggtgagactctttgggaattagctaaaaaatataacacaacagttaatgatcttataaaaataaatgggcttgatgaatctgataatattgaaggtggacaaaaactaataataccaggaagagcaattttttaaaacaaaacatatttaaggatctctaagagaggtctctttttttattgaaattttcatgtaggaaatttattgaataaatatatttgttagtggcaagaatatatatcatgcgatatgaggtgagaaagttgaatgataatttaagtggaaatttaattattataggaggcgcagaagataaagaaggaaagagagaaatattaaaaaaagtatgtgattccattgataaagataatgacatattactaatagcaactatagctacagaatttccagaagaagcagcagaaaaatataaaaaagtttttagtgatttaaaagtaaaaaacctaaaggtacttgatataagctgtagaaaagatgcttttgatgaaaataatgtagagctaataaatagctgttcgttaattttttttactggaggtgatcaactaagaataacaagtttggttggaggtactcctgtttatgactcattaagaaaatgtttgacaaagggtatttatatagttggaacttcagctggtgcatctgttatgagtgatacaatgatcgttcaaggaaatgatgatgattcaccaagaaagtgtacattgaaaatggcaccagggttaagctttataaggaatgttataattgatcagcattttgctcaaagaggtagaataggacgactacttgtgggaatagctgagaatcctgaagttttaggaatcggaattgatgaaaatactgctatatgtgtcaatcaagatggcaaaatagaagtagtaggagaaggcgcagtttattttattgatggaagtaatattacatatacaaacgtatcagaattgcatagtgatgaaatattgagtatgcataatgttaagttacatattttaacaaatggaaataaatttgatttaataaaaaggtcaccttttgaggaggaaaaaaattagctatgaaaatagtaaagaaaagaatatatgaaggaaaaaatatatattctcataaaaaatgtattagaattgatgtagatttagaaggatattctgagatacctagtaaaaaaatccctaattttaattttaatattgtagaaattttaccagaactaaaaaagcacagatgtggaattgatgaagaaggcggttttgtaaaaagacttgaagaaggaacatatttggctcatatctgtgaacattgtattattgcaatccaaaatattttaggtatggatgtatcctatggtaaagcaagagaaataaaaggtgaattgtattatattatagttcaatatgaatatgaaaatactgctattgaaataattaatttagctgttgatttgattaattcattaataaaaagtagtcctattaattttaatggaagactacaggaaattaaacagactttgcaaagagagactatcggaccaagtacaaagtcaatttgtgatgcagcgaaaaactatggattaccagttactgagcttggcaaaagtggaatataccaaatagggtatggtaaacaaggtaggataatagaagctgcaataagcaataaaacaaattgtgtaggagtagatatatcgtgtgataaatttcttacaaaacagttactagatattcaaaatatacctgtagcagaaggaagaaaagtatttaatataataggtcttttacgagaagctgaatttattggatatccagttgttattaaacctcaatatggtaataaaggaaagggagtgatgcttaatttaaaaaatgaaaaagaattaataaaggcttacacatctcttttaaagattactaaggatataattattgaaaaatatgttaagggtaatgattatagaatttgtgttgttgattataaagttgttgccgcatcacttagagtagttccatttgttattggtgatggaaaaagcaatataaaagctttaataaatattttgaataatgatccattaagaggtcaagatcatgaaaaacctttaacaacaataaaatttgataaagagctttgtaattgtttatatagacagaatatgagtcttgattatatacctaataaaggtgaaaaagttatacttagagaaaatgcaaacttatcaacaggaggaattgctgttgattgtactgatgatgtatgtgatgaaaatattgattattgtataagagctgcaaaagcattaggtttagatatttgtggtgtagatatatgtactgaagatataagtattcctattgataaacaaaatggaatagttatggaggttaatgctgcaccaggaataagaatgcatcattttccttcgcaaggtaaaaaaagagatgtaggaaaagctatagtggatatgctttatgaaggaagaccttctaacatacctgtaatatctgtaacaggtactaatggaaaaacaacgacaacaagaatgataggccatgttcttaagatgatgggtatgactactggaataacatcaactgatggaatttatataaatgataaatgtattcacaaaggtgatgattcagggtttaacagtgcaaaaacactattattgaatagagatgttgaagctgtagttttagaaactgcaaggggaggacttgtaagaagaggtctagcatatgatttggctgatgtagctgtcataacaaatattacaaatgatcatttaggtcttgatggtattgattcaatggaagatttaatgtttgtaaaatcattagtaggagaagaagtaaaggaaaatggatatactgtgataaatgctgatgataagtatagtaaaagaattttagatagaataagttgtgaaaaaatttatttttctaaatcaaaagataacgaattaataaaagaaaatataaacgatggtaaaatagctgtttttatagaagataataatatttgtgtaataaataatcatagaaaatatttaataatgtccatagatgaattaccaatatcatataatggaatattaacatataacatagaaaatgctatggctgcttgtgccgcattagttggattaaatatagattactgtatgataagtaaaggattttcagattttatgccttgtgatgataatgaaggtcgctttaatatgtttgaatattatggtcgaaaggtgattttagattatggtcataatattgaagggtataaagctgttttatcatgcataaataaactcaaaactaaaaatagattaattggtgttgtaggagtaccaggagatcgacaagataatgttataaaagaaattggtgaaatatgctgtgaatatttggatgaaataattataaaagaagataaagatagaagaggaagatcaattggtgaagtatctcaattattaaaaatatctatgttaaaaaatagcaataaaaaaaatgttaaggtatatttagatgaagttgatgcacttgaatatgcaataaagattagcaaaaaagatgatataataatagtattttatgaaaatatagaacctcttcttaattatataaataataatgagcaggaaagaatcaataagatgagttaataaatagttttatctcaacaactaaattagacaggaatttttacctatgataaaataatgttaaattgctatgaaaggataagtagaaatgaaaattaaggcttatgcaaaaattaacattgccttagatgttgttgggaagagagaagatggctatcatttattgaagatgattatgcagactgttgatttatatgatgtgattgaaataacaaagattgattcagatataaaattaatttgtaataaaccctatgttccaatagatgaaaggaatttagcgtataaagctgcaaaattatttaaagaaacctacaatatagaagacggtgtttctataaatcttacaaaaaatataccagtttctgcaggcatggcaggaggaagcactgatgcagctggagtattaaagcttatgaatagaatttttaatattaatgcaagtgatgaagaattaagggcattaggattaaaacttggagctgatgttccatattgtattaatggtggaacggcattatgtgaaggtataggtgaaaaaataacacaattaaagccttttaatgataagatagtagttatagtaaaaccaccatttggagtatctactaaagaagtgtataaggattttgatttatctaaagttatctttcatcctagaactgaagatataattagagcaatggaaaatgatgatattcactttgtttctaataatatgaaaaatttattagaaaatgtaacattaagaaaacatagagttattttaaacataaaagaatcaatgaggtcttatgatgctttaggaacaatgatgagcggaagtggacctacagtatttgctttttttgatgatatgttaaaagctcagatttgttatgatgaaatgaaaaagaaatacaaagatgtttttctatcaagaacaatataaatttaatttatattaaatattttgtataaaacccctgtaagtggttaataatttcaactacaagggggtttgtttatgagaaagttttttattgatacaagagtaatatttattttagcattagttgttatatcaaacattttttgtggatgtactactgtaactgttgataaagtgtgtgtaaataatttagaggcaaaaacacttaattataatgatgttaaggattctttgataagatttcatgtgattgctaacagtgatagtgatgaagatcaacagttaaaactaaaggtaaaaaataaggttattgaatatttatatccatacttaaaagaaagtgaatctattgagaattcaagaaaaataataactgataatatgaacaatgttaaagcattagcagaagaagttataaaagaagaaggatatagttataatgttaatctgcaattatcaagggaaaattttccggacaagtcttatggaaacattgttcttccacaaggaaactatgaagcttttagaataataataggcagtggtgaaggtagaaactggtggtgtgtaatgttccctcctttatgctttgttgatgaatctaaagcagaagtagagtatgataaagtggaagaagaaatagaaaaacaagaaaaaaataaaacacaagatttaaaaaatagtgatgaaaattctaataataatgatattaagattaagtttaaattagtagaagttattcagaatttatttaaatagggggattaagtacaatgacaagagcattagcgatgatttcaggtggattagatagtatattagccgctaaattaataaaagaacaaggtatagatgttattggaatatgttttagatcatatttctttaatgaagaaaatgcaaagagaatgacgaaacaaataggaatacctttagaggtaatagatttttcaaaagaacattttgatatggttaagagtccagagcatggctggggaaaaaatatgaatccatgtattgattgtcatgcaatgatgatgagatatagtggagaacttcttaaaaaatttaatgctgattttataattactggagaagttttaaatcagagacctatgtctcaaaatagatctgctttagatgttgttaaaaagcagtctgggtttagtgataaaattttaagacctttatgtgcaaaaaatttaaaggcaacacaaatggaagaagatggactagttgatagagaaaagttattagatatttcaggcagaaatagaaaacctcaaatggctttagcagaaaaatgggggattaaagattatccatcaccagcaggcggatgcaagcttacagagcctaattattcaataagattaaaagatgtattagatagaaaaggtgatgcaacagagaaagatatacatttacttaagtatggaagacattttgttagtgataataatatcaagataatcgtgtctagaactgctgatgaaggtaatgaattgaaaaaattattaaataaaaatgatttaatgtttattacaagtaattttaatggtgctatggtgattataccagaaggatataatccaaaagaagatgatattatattagcttgtagattagcggtaagatatagtaagggcagagatgaagaaaatgttgaggttaaatatggaaatgtatcaactaatttttcggaagtaagatacgtttcttcattagatcaagaagaacttgaaaaatataatattaactaaattatacaattaataaaataaatttaatttgtatgttggaggatataatggttaagaatgcagtagttactgttcaaagtagagtatcagttgaagatgaattaatagaagtggttactccaggaaaattttatataactaaaagtggatataaaattgaatatgatgaaaccaaactttcaggtatggaaggtactaaaactactatgataattaaaaataattattttaagttaaacagagttggaacaactgaaactaatatggaatttgagattaataaacagtcagtatctttatataaaacaccatttggtgcaatgagtgttgtaattgatactaaaagtttggaaatcaatgtagatgataatggcggaattgtacatatagtatatactttgaatgttgaaggtcaacaattaatagaaactgatttaaatgtaattataaaagcataatagaaataattaagttttcatatttaagttttcatttaaatatgaaaacttatttttttatatttaaataattatcaatataattatttaaatatgattaagaaagattaattttggatataactacttttagaattacttttgacttaatgcattgacgacttaaaattatagaaaataaaaatgttaaaattaatattgaatggttaaggttgatggtatgtataaaaatgattatgttaaagtgctcagtattatatgcagatattacggaacaaatgaaaatcaattttatgaacttttaaagaataaagaaaaaaagtttttacttttacttatcttaaaaaataataatatactggataattatgaattgattaatatgcttggaatagggagttttaaaaagatgaagagcaatattaaaactgcagaagagaaatttttgattaatagttattttagaaaagaatatgttgaattagaagaaaatataaaaaaacaaatagactagcaaaaaaagactagatattaataaagatatgtgatattatatatcctatgttattaaaaacaacacaaataaaccaataagaatctgatttattgggtgacttttagtatatcactacataatgaataagtcaacaaaaaataataaataaatataaatttatttcgacataggaggataagatgagtaatacaaaatacatttttgttacaggtggagttgtatctggtttaggaaaagggataacagcagcatctcttggaagacttttaaaaaataggggtttaaaaatttcaatacaaaaatttgatccatatttaaatgttgatccaggaacaatgagcccttaccaacacggagaagtttttgtcactgatgatggagctgaaacagacttagatttaggacattatgaaagatttatagatgaaagcttaagtaagaattctaatgtaactacaggtagaatatatagttcggttatagaaaaagaaagaaaaggggaataccttggaggaactgtacaagtaatacctcatataactaatgagataaaagataaagtttatcaagttgcaaaagaaagagatttagatgtagttatcactgaaataggtggaactgttggagatatcgaatcacaaccatttttagaagcaataagacaaattaagagcgaagttggaacagaaaatgtatgttatattcatgttacattagtaccttatttgagaaaaggcggagaattaaaaactaagccaactcaacactcagtaaaagaattgagaacaattggtattcaaccagatataatagtatgtagaactgaacaggaattatcagatgatatcaaatctaaaatcggtttattctgtaatatagaaggtaagtcggttattcaaaatcttgatgcagatcatctttatgaagttccattaatgttacataatgaaggtttagataatttagtatgtgaaaaattacacttaggatgtaaggacatagagaatactgaatggataaacatggttgaaagaataaagaatcttaaagaaaatgttgaaatagcattagttggtaaatatgtagaattacatgatgcatacatatcagtagttgaggcattaagtcatggtggatatgctaataattcaaaagttaagataagatgggtaaatgctgaagaagttgaaagcggagatgtaaatagtatactaagaggtgttgatggagttttagttccaggtggatttggtgatagaggaatcgaaggtaagatatcatcaatacaatgggctagagaaaataaagtaccattcttaggtatatgtttaggtatgcaatgttcagttatagaatatgcaagaaatgttttaggatttgaaggtgcaaatagttcggaaattaatcctaatacaaaatatcctgtaattgatattatgcatgatcaaaaagacatagaaaaccttggtggaactatgagattaggtcaatatccatgtaaattagatatggaaagcacttcatacgaagtttatggtaaagaaaatatcaatgaaagacatagacatagatatgaattcaacaatgactatagaaaacaaatagctgaagctggtatgagaattgctggaacaagtcctgatgaaagattagtagaaattgttgaagtagaagatcatccatggtatgttgcagtacaattccatcctgaattaaaatcaagaccaaataaaccacatccattattttcaggatttattgaagcagcattaaatcatagtaaataatatttaatttatataaaaagcaatttgtaatattaaaaaaattaatatataataaagtaaactggtgaaatgattatttcaccagtttaaaattattataaattaaatttttattatttccctcagttttaagatttgatattatataatattaaatttcacattaatacaatttatgtaattaattatcacatcaagtaatctttaaaaattttccgaagaagaatgttatataaaattttatagagaaatatcgagcctatagattttggaggtgtaagtttgattaaacaagattatgaaagcatgaccttaagcaaattaaaggaaattgcaaaagaattagaaattaagaatatatcaaaatataagaaaaatgaactgatagaagaaataataagtgtttctccaaattcaataaaaaaagatggagtaattcttagagaaaatatttctccaaaagcagttgaaaaaatacaaagatcagatttagaaatgaaaaattcaaacagtaattcggaaaattcaaagatacatactggtgaagataaaagagaaactagtaatataaaagataggaatttcgaaaagaacgtaaaaagagattatagcgaaaatcaaaatgtaaatagtaatagaaatgatgattctcaaaatgaaaaaaaagaagtattaagagaaatgataaatgaatctaatagtgctaaaggtatattagaaatactggaaaataataattttggatttttaagatgcaaaaattatttaacaagcagtgaagatatatatgtatcgccatcacaaattagaagatttaatttgagaacgggtgatgaagttgaaggtaaaataagagaagcaaaagaaagcgaaaagtttaaagcgttattatttgttcaaaaagttaatggtgaagcacctgaaaaggcgataggaagaaaatcttttgaaacattaactccaatatatccaacggaaagattaaaacttgagacacaaaacagtggagacctttcatctagattgatggatataatatgcccattaggaaaaggtcaaagaggtgttattgtagctccgcctaaggctggaaagactactttattaaaaaaagtagcacaaaacattgttaaaaattatccggatataaagcttatagttcttcttatagatgaaagaccagaagaagttacagatatgattagatctataaatggagatgtagtttattcaacatttgatgaagagccacaaaatcatgctaaggtttctcaaatggttttagaaagagccaaaagaatggttgaacaaggaaaagatgtagttatacttatggatagtataactagattatctagagcttacaacttaacgataacaccaacaggaagaactttatcaggaggtcttgatcctggagcgttgataatgccaaagaaattttttggtgcagcaagaaatattgaagaaggtggaagtcttacaattttagccacagcacttgttgaaacaggttcaagaatggatgatatgatttttgaggaatttaaaggaacaggaaatatggaagttcatcttgatagaagacttcaagaaagaagaattttccccgcaattgatgtatataaatcaggtactagaaaagaagatttattattatctaaagaggaacttgaagtagcattttcaattagaaaaattatgtataaggatggaaatgcagatgatgttactgaaaatcttataaatatgctttcaaaaactaaaaataacgaagagtttattgaaacttttaagaaaaacaattttaagaaataaaaataaagtgactcattagaaataatgcagtcactttatttttttgatctatttattaagtcctctgccacataaactattttatctaaagaataagttgaggccagtgactttaatctattttttctatctgataatgatttagggttgtttatcaaatcattaattatgtcattaatgtcagctaggttatttactagaatagaatatctttcacttgttaaaaaatctatattttcgttttcctgtccaggtattgcaaatggaattattaaaggaatgttttttactattgattcagttactgttaatccgcctggttttgagattattacgtcacaataatccattaaataagaaacatcttttgtaaaacctaaaatatgaagtttcttattttgaaataaattttcattacaatattgagttagagtattttttaattttatatttttcccacatacaacagtaattctgagtttatttggattttttaacagttcttttaatactgaagaaatttgatttaatcctaagcttccactcattagcagtaaattaaaatatgttttatcctttaattcagatgcatttgttatttcggtatagaattttttattaattggaattcctaaaggatatatcttttctgcatctatattcctttcaataagtgatttttttgtgtattcgctgccagttatatatgcatcaacataattgcttatataagtataatgggctttaaaatcagttacaattaagatataaggaatatttagtccttttttctttaattcagagataattctagtacttaaagcatgggtggcaacaattacatcaggttttatttctgtaataagctttgatacttttcttcttgaaaagaaaaaaggaaaatttagcaatgcatttactattcttgtgtctgttaatttataaaacgcaccatatgtttttggaaatttggatgccatgagttcataaccctttacaattatatcattaagaaacttactattgttttttaaaaaatcatgttttactatttcataacctttatctttaaatgaatctgaaacagattctgctgcctggttatgaccttgccccgtggagattgttaagattaaaacttttttcacgaaattcactcatttccaatatattctaattagttagttattataattataatactttttaaatgccaatatgttaaaaaaaaattaaaattagcacatatagttatcaaatattactattatttccaaatagttaaaaaatattattagttgctatattattagaattttaagaaaaaaagagaaagacaatgtctttctctaaatttcctatttgttgttaagaccgaatctcttgttgaatttatcaactcttccgccaacgtcaacgattttttgcttaccagtgaagaatgggtggcatttagagcatatttcaactttaagttcttctttaacagaaccagtagtgaaagtgtttccacatgcacacttaaccacagcatcgtgatggtattctggatgtatgccttctctcattatttttcacctctttcagttaataaatagttattaaatcatcaataactatttgattatatcatagggggattagagcgtcaataaatttgtaaggttaagtatattgaaaaatatgaattatatgtatttaggtgtttatatgaaaaattaagtattaatatgatataattaatacttaattgtaattaaaaaatttaaaaaaattaatattttaataaatgttatacatgttaattcaaaaaaatcatataaggatttgttaccttaattatcaaattacaattattaattggaacagatatatttttaattacatttaattttataattactattatgatgctttttatgataagtattaaatgatataatcgagtatgataaagaaaaaaggagacacaaatacagatgagtaaattatattttagatatggtgcaatgaattctggaaaatcaacacatttaatgcaagttgcccacaactatgaagaacgaggtatgaaggtacttattgtaaagccaagagttgatacaaaaggtggagatacacttgtttctagacttggagtaaatagacatgtggatttattaatttccaatgatgaaaatttatttaccatagttgatggatatttaaaagaaggaaaaagaatagattgtatattagttgatgaagttcagttcatgaaatcaaatcagatagatcaactatttgaaattgcagttaaaattgatatccctataatttgttatggacttaggactgactttaagagggaaggatttgagggaagtacaagacttcttttattagctcatagtattgaagaaatgaaaactatatgcgcatgtggaagaaaagctatatttaatggaagaaaagttaatgggaaatttgtgtttgaaggggaacagattgccatagatgaagaaaataatgttgaatatgaagcattatgtggacactgctattacaaatacaaagaaaatttataagagagtaagtgatgtatataaatgaaaaggcgtgatgtgggaggtcaggctgtaattgagggcgttatgatgaggggaagtaaaagccttgcaacagctgttagaactccaaaggggaatatagaaataaattataaggataatagacctataacaaaaaaacatcctatattaaatataccatttttaagaggattttttgtacttatagaatctatgaaaattggaatggagtctttgaattattcggcttcgtttttagatgatgaggatgaagaaccaacaaaattcgaattatggcttgaaaagaaattaggaaaaagggctaatgatgtaataataggatttacaatgattatatcatttattttttctataggattatttgtagctttaccaactgggattgcatcgatatttaaaaatatgggagcttctaatttagcactaaatttaatagaagcatttataagaatatccattcttataggatatatgtacgttattagcaaaatgaaagatatatataggttatttcaatatcatggtgctgagcataagacaatattttgttatgaatcaatggaagaacttactgtagagaatgtaagaaaacagccaagattacatccaagatgtggaacaaattttatgttccttataatgtttgtgagtatagttattttttcatgtactggatggggtggaattgttgaaagattattacttagaattattcttataccagttgttactggtataagttatgaactaataaagtggttaggaaagagtgatggaaagcttgctaggataatagcatatcctggattaaaactgcaattacttacaacgaaggagcctgatgattcacaaatagaagttgcaatagcatcattaaaggctgcggaagggattgaagatttgaataaaacaatagaagagttaattaacacaggaacaaaaacattaaaagataatggaatagatacagctaggcttgatacagaactattactaggaaatgtaatagaaaaagaaagattgtatctaattactcataaagaggaaacaataggtaaagatcagtgtgatgaattttttgagttaattgaaaagagacgaaagaaaatgcctgttaagtatatattaaacaaatgtgaatttatggggattgatcttcatgttgaagaaggggttttgattcctagggatgatacagaactacttgttgatgaggttttaaaaaatatttcagaagatgatgaaaaacagatttgcgatttatgctgtggatctggagcaataggtatatcattagcgtgtttaagaaaaaatataaaggtagatttacttgactattatccgattcctgagaaagtaacattaataaatatagaaaagcacaatcttcaagaacgagtatcttttagtaagagtgatcttcttgatgtttccataaaagcttcaaaaaaatatgatattatagtttcaaatccaccttatattgaagaagaagaaatagagaaacttatggatgatgttcaaaaatatgagcctcatactgcattaagtggtggaattgatggattagatttttataaaaaaatagttaatcaaagtattgaagttttaaatgaaaatggaatattagcatttgaaataggatataatcaaggtaaagcagtaaaatcattaatggaagaaaataattttaaagatgtaagagttattaaagactttgcaagtcttgatagaatagtaattggacatttataacatataaagacaaatggaaaacattaatttttataatatagtgttttccattaataagtttaataatatatttttaaaataaatttaatgaattataaacatatttataatgatgtggtaaaatatgtgtagattattgtttaaataatggcagttgttgtagagttaattgattaagtatcgaaatatatgatataatataaaaatgccaaaaataaagtacggagtgattacatgttattagataaattagaatttatagaaaataaatatgacgaattatcagttaaaatcagtgatccatcaataatgcaaaatcaaaatgaatggagaaagctttgtaaagagcatgctgatttagagattatagtgaatgcttataaggaatataagaaagttactgaagacttagaagctaataaggaaatgctaagtgaagaaaatgacaaagaaatgagagaaatgcttagcgaagaaatttcagatcttactaaaagagaagttgaattagaaaatcatattcaaattttattattaccaaaagaccctaatgatgataagaatgtattcgttgaaatcagaggtggtgctggtggtgaggaagcagcattatttgcttataacttattcagaatgtacacaagatatgcagaaactcaaagatgggcagtagaaattatgagtttaaatgaaacagatcttggtggatttaaagaagttgtatttatgataaaaggtaatggagcatactctaagttaaaatatgaaagtggtgttcatagagtacaaagagtacctgatactgaatcaagtggaagaattcatacatcaacatcaacagtagctgttttaccagaagtggacgatgttgaaattgaaataagtgaaaaagatttaagaattgatgtatttagagcatcaggaaacggtggacaatgcgttaatactacagattcagcggtaagaatcacacatttaccaagtggtcttgtagtttcatgtcaggatgaaaagtcacagttaaagaataaagaaaaggctatgaaagtattaaagtctagactttatgaacaggctgaaagagaaagagctgaaggaatagctgaagacagaaagagtcaggttggtactggagatagaagtgaaagaataagaacttacaactatccacaaggtagagttactgatcatagaatagggttaactctatataaattagaaactttcttgaatggtgacattgatgaaatgattaatgctttaattacagcagatcaagctgaaaaaatgaaagcaatgggaaatacacaagtataataattacttaattagggattgtatcaataattagtttgaggaaatttagttaatatattttctttaattatgttttgagacagtccctttaataaagtaattgggggaatgggaatggatatatatacagccataaagaaagaaagatttaatttaaaaatattttttattactatgtctataatttcaatcattcttcctatagcagttgtattaactaatcttactacggtattttacttatgctatttaggggttgttgaattattgatagttatatctataataataagattgaattattacaaagttatgtatagatgttctaataataagttaatatttaaaacaggaatttttacaaaagaaaatttaatcatttgtgataaagttgcattagtacatacgaataaatctgactatgatttagaaatagttataataacaagtgtaaaattcaaaaacaaggctcttagaaaaattgaaaaaaactttttcagaagatatcctcaaatggaaaaagaatataattatataaaaaaatgaatccagaaaaagaatattattttcaagtaataagaaggggcggacttaaaaaatatttattgttagatttaatatataaaaattgtgttaaagcaacatatactgaggagagtattcaaaacataaagatagctagaggtcaaactatagtttaatagaaggaaggtaaaatattgaatacaaaagttagctatataaaaaatattgatgaggaagaatataaaatagaagaagctgcaaagattataaaagagggtggaattgtagcatttcctacagaaacagtttatggtcttggagcagatgctcttaatgaagatgcagtaaagaaaatttttgttgcaaaaggaaggccacaagataatccacttataattcatgttgcatcaaaaaatattgaacattatgtagatgaaattcctgaaatagctaaagaattaatggataaattttggccaggaccacttactataatattaaaaaagaatgatattattcctaatataacgagtgctagtcttgattctataggagttagaatgcctgataatgaaatagcaagaaaacttattgaactatcaggaactacaattgctgcaccatcagctaatataagtggaagaccaagtccaacagatattgaaagatgtgtagaagatcttgatggaagagttgactatattataggtggatgtcatagtaagataggagtggaatctactatagtagattgtactgtagatccaccactagttttaagaccaggtggaataacattagagatgctcaaagaaatagattcaagaatagaaatagataaagctataatgcagaaaccaagtgaaaatttaaaacctaaggcaccaggaatgaagtatagacattatgcaccaaaagcaaaagttactataatttcaggaaatagaaaaaagactgttgcaaaaataaaagaaatggtaaactataatatagaaaaacaaaaaaagtatgcatattaactgttgaagaaaacgaaaaggagtatcagcaaggtattaaaattacattaggtagtctttcggatttaacaacagttgctaaaaatttatttgaagctttaagaaaatgtgatgatttaggtgcagatttaattttagcagaagcatatgaagaaaaaggtgtcggagtggctataatgaataggcttaataaagcagctggttttgacataattaatgtttaatttttaggaggtactttattatgaaaattgcagtaggttgcgatcatggtggatttgaattaaaaaatgaaattatcaaatatttagaaagtgaaaagtatgaaataaaagattttggtacttattcaactgattcttgtgactatcctgatatagcacaaccagtagcagaagcagtagcagcaaaagagtttgattttgggattttaatttgtggaacaggtattggaatcggaatagctgcgaataaggtgccaggtataagagcagccctatgctcagatacttttagtgctcatgcaacaagacaacacaataatgcaaatatattaactatgggtcaaagagtagttggtacaggattggcattagatatagtaaagacatttttatcatctgaatttgaaggtgatagacatagtaagagaataaataaaatcacagctattgaagaaaaatatggaaaatagtttgaagagttaaattcaaagcgttgatttataactaaatacaagtagcctttaatcaataaatatattaaatatgcttattgataaatatacaatttaaataataatatgaatgaataaacttggaggaattaaaaaatgagtaaagtaacagaaataaaccatcctttaatattacataagttagctatattaagaaatgaagaaacagggtctaaggaatttagacatttagttgaagaaatttcaatgttaatggcatatgaagtaacaagagatttaagtacagaagaagttgaagttaagactcctgtttcattaacaaaatgtaaaatgctttcaggaaagaaaatggcagttgtacctatattaagagctggacttggaatggttgatggtgtacttaaccttattccagcagcaaaagttggtcatataggattatacagagatgaagaaacacttcaaccagtagaatatttctgtaagctaccacaagatatagcagagagagatgtaattgttgttgatccaatgcttgcaacaggaggttcttctatcgatgcattaactatgttaaagaaaagaggagctaaaaatttaagattaatgtgtctagttggagcaccagaaggaattgaagctatacaaaatgctcatccagatgtagacatatatcttgcatctatagatgaaaaattaaatgaacatggatatatagttccaggtcttggagatgcaggcgatagattatttggaactaaataataactagaggttttggggatggatagaagagataaacataattattatttagatattgcagaaaccgtactagaaagaggaacatgtatgagacgaaattacggttctataatagtgaaaaatgatgaaataatttctactggttatacaggagctccaagagggagaaaaaactgtattgatttagatagttgtataagagaaaaattaaatgttccaagaggaactcattatgaactttgtagaagtgttcatagtgaggcaaatgcaataataagtgcatcaagaagagatatgattggggctactttatatcttgtaggaaaagatgcaaaaactaaaaagtatgttgaaaatgcaaactcatgttcaatgtgcaaaagattaattataaattcaggtatttcttatgttgtaataagagattctaaagatttattcagagaaatatgtgtggattcatggattgatgatgatgattctttgaaagtatatgatgaagcaggctattaataaaatttttatcttttatattatttatccagcagaactttagtctgctggataaattgcaaagagttcattagtcacagagttggaggtataaaagtgataaagaaaaagattattaccatttttggaacacgtccagaagcaataaaaatggcacctttagtaaaggaattagaacgaagagaagaaattgaatcaaaagtatgtgtaaccgctcaacatagagaaatgctagatcaggtgctagaattatttgacataacaccggattttgatttaaatataatgaaaacaaagcaaagtttaacaggaattacaaataaggttttagaaggcttagatgaagtttttaaggaagaaaaacctgatatgatattagtgcatggtgatacaacaacaacgtttgcaggagcacttgctgctttttatcagcaaataagagttggtcatgtagaagcaggccttagaacatttaataaatattttccatttccagaagaaatgaatagaaaattaactggaagtttagcagatttacactttgcacctacaaaaggctcaaaagataatctattaagagaaggtataaatgaaagcgatatctacataacaggaaacactgtaattgatgcaatgaaacataccgttgagaaagattatgtatttgaaacagaagaattaaataatattgactttaataagaaagttataatgataacagctcatagaagagaaaattggggtcaaggaatagaaaatatttgtgaagcattaaataatatagttgagcaaaatccagatgttgaattagtttatttagttcacttaaatcctgtagttaaagatgtagtgtttgaaaaacttggtgataaagaaagaattcacttattatctcctttagatactaaagaaacacataacttaatgaataaatcatttatggttatgactgattcaggtggtttacaagaagaagcacctcatttaggaaaaccagttcttgtattaagagatgttactgaaagaccagaagcagttgaagctggaactgtaaaactcgttggaactaatgttgaaacaattataagagaagcaaataaattacttcaagatgaaaattcttataatagaatgagcaaagctattaatccatatggagatggaatagcatctaagagaatagttaatgctatattaaaatattatgaattaactgatcatgaagtagatgaatttaaaagataattaattttataaatataaagcagaaatttacgcataatgtaatttctgctttatttattttctaaaattatatacttttgataaaaaataaaactttgtctaaaatttaacaataaactattgataaaaaagttaaaaatggtataattatcttatgttaataatttaacgaaaagtaaataaaaaacataattataattttaaaataatttatgatatttttaggaggtaaattatgaaagacgtagttatagtaagcgctgtaagaacagcattaggatcttttggaggaacattaaaggatgtttcagcagtagacttaggtgcaacagtaattaaggaagcaataacaagagcaggtgttaaaccagaattagtagaagaagttataatgggaaatgttatacaagcaggtcttggacaaaacacagcaagacaagctacaataaaagctgggttaccaaatgaagttccagctatgacaatcaataaagtttgtggatcaggtttaagatcagttagtttagctgctcaaatgattaaagcaggggatgcagatattatagttgcaggtggtatggaaaacatgtcagcagcaccatatgcattaccaactactagatggggacaaagaatgaatgatggtaaaatagtggatactatggttaaagatgcattatgggatgcatttaataattaccacatgggtgttacagcagaaaacatcgcaaaagaatggggaattacaaaagaagaacaagatgctttctcagcatcatcacaacaaaaagcagaaagagctattaaagaaggtagatttaaagatgaaatagttccagttattattcctcaaagaaaaggtgaaccaaaagtatttgatactgatgaattcccaagattcggaacaacagcagaaactttaggaaaattaaaaccttgtttcattaaagatggaacagttacagctggtaatgcatcaggaattaatgatggagcagcagctttcgtaataatgagtgcagaaaaagcagaagaattaggaataaaaccacttgctaaaattctttcttatggttcaaaaggattagatccagctataatgggatacggtccattccatgcaactaaaaaagcattagaagtggctaatcttacagttgaagacttagacttaatcgaagcaaacgaagcttttgcagctcaaagtttagcagtagctaaggatttaaaattcgatatggataaagtaaatgtaaatggtggagctatagctttaggacatccagtaggagcttcaggagcaagaatacttgttactcttctttatgaaatggaaaagagagactctaaaaaaggtttagctacattatgtatcggtggtggtatgggaactgctgtcatcgttgaaagaatgtaatttaaataagtttatataaattcattaaaagagaattcattttattaaatgaattctctttttttgcataatattaattcaaaaaaagaatattaatattataactttcaaatttaataaatgattattgataatattgaaatataactgtaatatatagactaagttatttcaaaaatgaattactttattaagttttcagagtgaaatctatataaatcaatagataatagagagattatgaataagatatttgttttcagagaaaaatagtacagaaatacatacctctatgaaaaattagcaaacagcattttacaaaaaaatataaaaaaaatttgcaagatttaatttctaatcatgtatgctctaattatgagttatattaatgtatcttaaagcgtttttaatactttgtaatagagtgtataaaagcattttgcaatccatatttaagaaaattgtaagaaaaaaaaaataaattattgaataagatattttctttgtattcactagtacaaaaaaaatacaaaaaccaaaagttaacaaaaaatacacaattatattaaaaattatagataatcaaagaaaaatgaaaaaaaaactaatgaaaatgttatcaaagacaagcaatactttattcaaaaaaagaatattcagataattgaataattatatttataaaaaattataaaagaagaaaataagagtaatatctaacattagctaagtaatttgaagaaaatgagagttattttaatattactttgaaaaaagagtgaatttaatggaaaataatgctttgttaaagatgtccatggcgatataatatctgatattgaagacaggaggtatgtatgagtaaagatatgaataaacttcttcaacaaactataaaatatgatttgggaagcggattattgatagctttattgatagtattatcttcctcgtttttaaatgcaatgatgtactttttaggcataatagttgggatgctgaatttcgtatgcagttattatgttacaacaaaaatgttatttgaaggaggtgctagaagcgttctagcggtgcttataactttttttagaattttagctgtagttataattgctataccactaatgaataatttgagatttgttgttttatatgttgctggatttatatctcatctagtagtccttggtatttcgtgcatgctaaaaaataaataaggaaaggaagtgcttaaagtggaatcgagcccaattatatattcccataattttggatcatttacatttaacattactacaagtgttataactcaatgggttataattttagtcttgggaatagggtcatttctattaacaagaaatttaaagctaaagcctggcaaattacaagctgctttagaaaagttatatcaaatgatatataatcttgtagaaaacactatgggaagtgtatatttatcctttttaccttatattggtacattgatggtttatttgttagtcttaaatttcttaggcttgataggttttaaacctccaactcaagatttaagtgtaacaatagcatttgcaattattacttttttagtagtaaatataaatgctataaaaaagaacgggattgcagattacggaaaaagttatatgcatccagtagcatttatgttaccaataaacattatggaaaaattagtacttccagtatcattgtctttgcgactttttggtaacatggtagcagctactatagttttagatttattatatactaaactaggtggaataaatatgtttgcccaattaggtttaccagtggttgcgcatgtgtattttgatttgttcgatggaacaattcaaatgttagtattctcaatgttaactatgattaacataaaagtaacagcagatgaataaaaaaaattaattattttgaggaggaattgtaatgagtttatcagttttagcagcaggtattgctgtattagcaggtatcggagcaggaataggtattggtatagcaacaggaaaggcagctgaagcagttggaagacaaccagaagcatcaggtaaaattatgactatgttaatattaggtgctggactttcagaagcaacagcaatatatgggttaattattgcattcatggcaatcgctaaataatcgattttatgagttaattatattgactccgaagggaggatataggtaaaaatggaaatagatttttcaacaatattaatgacatgggttaactttggaataattgtattaattttaaaacactttttttgggataaaattaaaggcataatagaagaaagacaagatgccatagatgaaaagttaactaaagcagatgaagattctgaaaaagcaagaatgtatttattacaaaatgaaagaatcttaaaagatgctaaagaagaaggtaaaaaaatcactgaaaaacaaaaacaaaaaggtgataagatttatgaagaaatagttgacagtgctaaaacagaagctaatgcattaatagaaagagctaatgtagaaatagaaagagaaaaagaaaaagctgaatatgaagttaaaaaacaagctgttaatttagctgtagaactttctattaaagccttagaaggtagcatagacgaagatgtacatagaaagcttatcagtgattttattgctaaggtaggtatgtaattatgtatgaatatttagatcgtagatatgcactagctctttatgaagtagctgaatctaaaggtaaagtagatgaataccttcaggacttaagagaaatttgtgatttagtagaaaataatcatgatttctatgaagtaatacgtcatccacagattaatactagaagaaagaaacaaagttttatcaatatatttaaaggtaaaatagatgaggaattattatctttccttttaatattaattgaaaaagacagaattctttatcttagagaaaagcttaacgagatggaaaaaatagatctcgaacgcaagaatacattaagaggggtaataaaaacagcagtacctcttttagataatgaatttaatgaattaaaagacatttttgaaaaaaaatatgataaaaatattattttcgaagctaaagtggacacaaaagttttgggtggagtatatgttagagttggaaatgatgttattgacgatactcttaagtccaaagtagatgaaatgaaagatttaatgcttagaaagaaatagaggtgaatccatgaatattaaaccagaagaaataacttctattataaaaaaagaaattgaaaaatatgaaaagcaaattaaaacagtagattctggtactattatccaagtaggagatggtgttgcgagagtttatggattagatgattgtatggaaggtgaattgctagaattccctaacgatgtttatggaatggcgcttaaccttgaacaagataatgttggatgtgttcttttaggatctgaagaaggaataaaggaaggcgatatagttaaaggaacaggaaagatagttcaagttccagtaggagatgccttaataggaagagttgtaaatgctctaggagaagctattgatggtaaaggtcctatattaactgatgaaacaagagcaatagaagttccagctccaagtatcattgatagaagttctgttaatgaaccacttcaaacaggaattaaggctattgattcaatgattccaattggtaaaggtcaaagagaacttataattggagatcgtcagactggtaaaacagcaattggtatagatactatactaaatcaaaaaggtaaagatgtaatttgtatatatgttgctataggtcaaaaacaatctacagttgcacatatagtaaatacattaactgaaatgggagcaatggattatagtgtagtagtaagctcaacagcagcagaatctgcaccacttcaatatcttgctccatatgcaggatgtagtattggtgaatattttatgcatcaaggaaaggacgtattaataatatatgatgacctttctaaacatgctgtagcttatagagctatgtcactattacttaagagaccaccaggaagagaagcttatccaggagatgtattctatatacattcaagattacttgaaagatcagctaaattatcacaagaattaggaggaggctcattaacagcacttcctataatagaaactcaagctggtgatgttactgcgtatataccaacaaatgtaatatcaattactgatggtcagatattccttgaaggagatttatttaatgcaggtcaaagaccagctattaatccaggtatatctgtatcaagagttggtggtaatgctcagattaaagcaatgaagcaagtaagtggtactttaagacttgaacttgcacaatatagagaactagaatcttttgctcagtttggatctgatttagatagcgattcaagtagaagacttcaaaaaggtaagagattaatggaagtattgaaacaagatcaataccaaccattagatgttgaaaaacaagttatgatgttatatgcaactgttaatgacttcttatctgatattaaagtaagtgatattagaaagtttgaaagagaattcttagaatttatggatactcatcatagagaagtaggtaaagctattggtacagaaaaagtattaactgatgatattaaatcaaaccttgaagcagcaatcattgaatttaagaaagtatttttgcaggaagcataacttatattaactcataattagcaattaacaattaataatataatgtagaaatcttaatagatttctacattatattaaagtaactatttattataaaaaatccctaactgggattttatatttaagattaattgttaattgctgactgtcaattaaattccaggaggtggaatacatgggtgcagctggacttattgatataaaaagaagaattaagtcagtagaaagtacaagaaaaattacaaatgccatgggacttgttgccacttctaagttaagaagatctagaaaagaattattagtaaatcaaaagtttattgattcaatagaaactattataaagaatctggcagcaactgttactgataatgaaagtatttattttacaggaaataatagtgaagataaattatatattgtaataacatcagaatcaggattatgtggtggatttaatggtggtgtagtatcttacttagaaaaagtaataggaaaagagagaggcaatgcaagagttattgtagttggaaagaggggcttagctatgttagaagatatggctttgaaccaatcgctgaatttgtagatatttcagatttaccaactataaaagaagcaaaaattatttttgaaaaagctcttaaattgtataaagataaagaaataagtgaagtaaatgtaatatattgtgattttgcttcaccagtaaagcagattcctacaagtgttaaaattttacctatagacagaaatgatggagaagctgaaggatgtattattgaacctaatgtagagacggttctaaatgattctttggagatttatttaaaagctaaaataagaaatattttattgagttcaaaatgcagtgagcagagtgctagaatgactgcaatggatggagcaacaagtaatgctaatgatttattggaatctctaaatcttaaattcaatagaataagacagggtatgataacacaagaaataagcgaaattgttggaggagcagaagctcaaaaatagtaaggaggtatatcttatgcctggaaagatgggaaaagtagttcaagtaattggaccagtaatagatataaagtttgattcagattctcttcctaatttatataacagtattcatataaacatgggagaacacactttagttgcagaagttgaacagcacgttggagatgatattgtaagagctattgcaatggaagctactgaaggtttaaaaagaggaatggaagctattgatacaggaagacctatttctgttccagtaggtaaagaagttctaggtagattatttaatgttttaggaaatcctattgataatgctgggggagttgatgcaaaggaaagttatcctatacatagaccagcaccaagctttaaagatcaagcggtagaacctgaaatgtttgaaacaggaattaaagttatagatttacttgctccttatcaaaaaggtggtaagacaggtctatttggtggagccggagttggtaaaacagttttaattcaggaacttataaataatatagcaaaagaacatggtggattatcagtctttactggagttggtgaaagatcaagagaaggtaatgacttatatcatgaaatgaaagactctggagttatagataagactgcattagtatttggacaaatgaatgaaccaccaggagcaagaatgagagttgcattaactggacttacaatggcagaatattttagagataaaggtcaagatgtattattattcatagataatatatttagatttactcaagctggttcagaagtatcagcattacttggaagaacaccttcagccgttggttatcaaccaacacttgcaactgaaatgggtgcgcttcaagaaagaattacatcaacagttaatggatcgattacatcagttcaagctgtttatgttcctgccgatgacttaactgacccagcaccagcaacaacatttactcacttagatgctaagacagttttatctagaagtattgttgaacttggaatttatccagcagttgatccgctagaatcatcatcaagaatgcttgatccaagaattgttggagatgaacactataaagtagctacagaagttaagaatgttcttgaaaaatataagcaattacaagatatcatcgctatattaggtgttgatgaattaggtgatgaagataaagctgtagttgcaagagcaagaagaattcaaagattcttatctcaaccatttactgtaggagaacaatttactggtatgccaggaaagtatgttccaataaaagaaactataagaggcttcaaagaaattcttgaaggtaagtatgatgatcttccagaatcagcatttttatttgcaggaactatagaagatgttatagaaaaagctaaaactttaaagtaaggagatgttagagtatggctaatagctttttactaaaaatagttacaccaagtcatgacgtttatgaaggaatggttcagcgtgtatttttaaagaattcagatggggaatttgaggttttagctaatcatgaaaatatgataacaagtacggtgcctaatatagcaaagtttattgatgaaaatggagaagcatttgagctctttatttcaacagcaattgttaatgttgttaagggtgaagttatcatttgtagtgatgcagcagaatttgctaaagatatcgattttgaaagagctgaaaaagctaaaaagagagcagaggaaaaaatgctttcaccagatatctttgacaaagaaagagtcaaacttgcattactaagagctaatgaaagaataaaattaaaaaataaatagatatatttataaaaatatgatttttaaatatttaatttaaaaatcatattttttttatgcttatataatttatttaataactagataggaatttaattataatctgacattaatattgaatataaacatgaatttgtacaatttatcacaaaatatagagtaatttatataataataatataaagttattaacagatggaataaaatttgaaatagtgacaatacttaagaaaagataaaggtgggagtgagttttatgaaaattaaaataagtataatatttcttgttttattatctttttttaatataggggctgtttcaaataataatatcaaaagttattcatttgataacttggaatctgtatatataaataaaagtgagtttgttgaaaatggttctaaaattcaatatagaactaaaaattccatagagcaggagaaagaaagggtagaaacttatcttgttactaattatttagtaacgtgtaaagaagttgcgcagaatagtattaaattttgtaatgataatttgcaaatagaagcagaattttggaaagatgatatagacatttatgtagtaataacagtagtaaataataatcctaataaaaaatagaagaattaacaaagatattaaaaggactaacaactgaagattttatagaatttcagtgctacaaatattacaaaggaagaatatcatttaaccatgaaactgaatatactgacgatatgtgtagtaggatttatgaatcaaatatgattagtttaaataatggatatacaggcagtgggtattgtagaaatggtgaaaaaataaattttgccataagtaattataatacaggtgcttatattattattggtacgccaataatatttacaacatactaacaattgaaatttggaggataatatggagaaaatagtagtaaagggtgtaaaagaactcaagggtgaagttaatataagcagtgctaaaaattcaattttacctataattgcggcaacaatactctgtccagaacctatagtaataaataatacgcccatgttagaagatgttgaagtaatttgtaaactactaaatgaacttaattgtgatattaatatatcgaaaattactaataaattagcaatagatacaaaaaatattgtagcaatagacgctaatgcagagcttattagaaaaatgagagcatcatttcttattatgggtcctatgcttgcgaggtttggatattgtaaattatcattaccaggtggatgcaatataggaagcagacctatagatttacatcttaaaggatttaaattgttaggagcagacattactatgggacatggatttgtggaggtaagagctaaaaaattaactggaaatagaatttatttagattttccttcagttggagcaacagaaaatataattatggcatctgttttagctaatggtgttacaataattgaaaatgcagctgaagagccagaaatatgggatttagcaaattttttaaacaaaatgggtgctaaaattgaaggtgcaggtttaggaaaaataacaattacaggtgtgacttcattgaaggggatagattatacgcctatatatgatagaatagaggctggaacctttatgatagcagctgctattacaaatagtaaaataagaattaatggagtaaatgaggagcatctacgtcctttaattgaaaaattaaaggagtcaggagttgtttttagtgaatataaaaattattctgtaactgttgatggacgatacaaacgtaatccattagatataaaaacgttaccatatccaggctttcctacagatatgcaagctcagattatgagtttactttctgtgactgaaggtgttagtgtaattactgaaactgtttttgaaaatagatttatgcatgttgcagagcttcagaggatgggtgctaacattaagatcgatggaagaactgctattgttgaaggcgtacctaaacttacaggatgccaagttaaagcgacagatttaagggcaggagcagctatgattttaggtggattagttgcagagggtgaaacaactgtaagtgatatatatcatattgatagaggttatgtagatatagaaggtaagtttagaaatataggtgcagatatatatagaattgatgaataggtaggttatctcaaaatattaatatatattttgagataacctatttttttatttatagaaaacctgtgtttggttaatgaaaatgtaagcttcccactatcaattattaaattaaagtatggctcagttactttttataaaaagtctgatttataagagtcagtaattataaagaaagttattatagttacataatcataatagagtcctaaaaacatataatttatagtgatggttttgggaggaattaaattatgagaatagttaatgaaaagggtaagaaacttaggataaatggaagtttaaaaagtgtagttattatgacttttattattttaattatcatgattgctttaccaattatatttttgaaagagagcaggaatacaagtaatatgtcatcatccggatttaaattgaatgatgaaaatatagtgaaaagctcaggtcttttctttccagagggaggaaaggtaaaattatatagaagagaaaaaaatacagtagaagagttagatttagaggaatatataaaaggcgttgttgcaagtgaaatgccagcgaattttgatgaagaggcacttaaagctcaggcagttgcagcaaggacatattatatgaataaaagaataaatccatgtaaagatgcagaaagtaagggcgcagaaatctgtgatagtactaattgtcaagtttatatggataaggaggaacgaatttcaaaatggagtcaaaaagatagtgaaagtaattggaataaaattgatgaagctgttgagtcaacaaaaggacaagtacttacatatgatgggactgttttggagtatcctcagttttttgcagtaagttcaggaaaaacagaagatgcagtggatgtattctctatgagtgtaccatacttaaaatctactgatagtaaaggtgaagaaatagcacctaaataccaaacaacatttagtatgcctttagatgattttatcaataaagtcaaatcaaagtataaggatgctaacgtatctaaaagtaatttaaaaaattcaatagaaatagaaagctatactgaaggaggaagcgtaaaggaaattaaagttggagataaggttattagtggaatagattttagaaagatattaaatttaaattctgcaaattttacaatatcttttaaaaataatgacattgtgtttttatgcaaaggatatggacatggtgtaggaatgagtcaatggggagctaatgcgatggctaaaagtggtagcaagtatgaggatatattaaagcattattatagcggagttgatataggggaaattaagtataaataaaggattaagtagaagtattatgtaataatacttctattttttatgtgtaggaaagtgtaatttaaatataatgtttgaatgtagtcaattcaataaagttagagagtttagaatttatagttaaggatcaaatgtaaaaagaatatttttaaaaaacaaaaattaaaaaactgtggctttccagtaaaattatcaatttaaaacatggagtagccacttttttatatgtggatagttaaattttattagtgtatattttaacattagttgcttacaaggggtacctacaagtagtgccagttatcatatattaagtgaaatgtataaagattatgtttagaaaaaaataaagtggacataatgtaagttaatagcagattaatgatgctatttgaaagaaatattaatataacataaaaaaataaaaatagtaaaaaatatgtattaaaattcaaaaaaaggaaaagataagtaaaggaggtgttcgtaatggacaaaaattttaaacagaaattaaaagatttaatgagtagggacggtttttacattgcattatttctttgtctttgtgtagttgttacagttggaactttttcatacaagaagttctcagctcaaaatcaagctaataagattcaagagacaagtgaagatgactcatacaacacagatgataataatgaggttgcaaatgcaaataatcagattcctaatgctgaaagagtagaaaacagcgttactaatgaagaaagtaaaaataataataaagaagataaacaacagaataaagatagcaataaatctacagtagtttctacaaataatagtgttaattttgtagttcctttaaatggggttgaaagcagaaattatacttatcctaagccagtacaagttggggaaaatgttttcagaactattaaaggtgtaaatttagaagctaaaattggaacagaagtaaaagcagcagcagatggagttgtagatcttgttgaaaattcaggagtagaagaaggtattgtagtagaaataaaacatgctaatggattaaaaacaagatatggaaatttagatgaaaatacatctgttaagcaaggtgataaagtgacagcaaatcaagtaattggtaaagttggagatacagcaaaagtttatagttcagatgtatttggtgaatttttaaatttacaagtaatcaatgctaatggagagcaagtaaatccagaaagctattttactttttcaaaatagtaaaatagtaaattcatattaattagccactttaaatagggctaattaatatgttatcaaaaaaaataaattgatatttatagaataatcctaaatatattttagataaaaatcatatttaggaaatttttaaataaatttaagaaggtgtattatatgaaagattatatagaagaaagagtactagatgtcgcaaaatatattattgaatctaaagcaacaataagaaaaactgctaaggtttttggggtaagtaagagtacaattcataaagatatgactgaaagattacctaagataaatcctgaaatagcagaagaaacacattctatattggaactaaacaaagcagaacgtcatattagaggcggaaaagcaactcaaatgaaatataaggctattgaatcttgataaaattaagactataatatattattagtagaattatgtaaacatagggattaatatgtattataggagtgaataaagtatgggcttttggagaacggggacagaccttgcaattgacttaggaacagcaacggttttggtttatgttaaaggaaaaggtgtaatattaaaggagccttcagtagttgcaataaatagaaacaataataatcttcttgctgttggagaagaagcaagaaagatgcttggtagaacaccaggaaatatagttgctttaagacctttaaaggatggtgttatttcggattatgatgtaacacaaaaaatgctaaaggagtttataagaaaagcatgtggaacaagaagtataagagctcctaaggttattgtatgtgtaccttctcaagctacagaagtagaaagaagagctgttattgatgctgctgcaaattcaggtgcaaaaacagttcatctaattgaagaaccacttgcagctgctataggtgcaggactggatataactaaaccaaatggttgtatggttgtagatattggcggaggaacttgtgacatagctgtaatatcattaggtggtgtagtagagagagaatctataaaaatagctggcgataaaatggataatgctattataaaatatgttagaaataaatataagctaatgattggagaaaaaacagcagaagaattaaaggttaacataggttctgcatttaagaattctagaaatttaacatgtatgatgaaaggtagaaacctaataacaggactgccagatgaaatagaaatatctacagaagaaataagacttgctattgatgatcctgttcaaaatatagttgaaacagtaaaaaaagtgttggaaagaactcctcctgaattagcatcagatataattgaaagaggaatattgatgactggtggaggagctttactacatggtttagataagctaatagaatttaggacaggagtttctgctacggttgcagaggatgctgtagaatgtgttgcaaaaggaacaggagaagttcttggatacatagataaattagatagtgaagtcaattcgcaacaaatagtgcttatagaataataaagaagactggaaataatataatttgttacttccagtcttctttattttgaaaaatttcatattaattgtttaacatattaagttatacgcatcgattaaagctttagatattgttttagccatatccattatgaaagaaagtctgatactacgagaaaagaaaaattcagagttatcactagaatcaacaatgccaattattgatgcaattccaacctcaggaagctcttttccaacacccttaccagggtggatagcataatttctagttctaacttgtcctacatcatcttgattacccaagcaggcatcaacacctataattgttgaatcaggatggatagcatgtatttctttaagacgttcatcgatatttagagcatgtattggtgaagacaaagttccataaactggaagaggaaagttattatctgttaatattgaacctactaaaggccctaaacaatcaccaatgcatttatcagtaccaatacaaactataacagtattttcagaaatataattgctaatctctaaagctaaatcgtaagagtatgttttggaattgttagaattagtatccggctttatcaaaggacatacctcctttataaaatatatatatgaaaaagtgagtccagttattataagaaaacttaaaaatataattaatgattaagaatttattctttattcaaaataaaaaagaataaaaaagctttattggaaataattagtaataaaaataagaaagagtgagacgttaattatgaaaaaaatttattttttacttatattttttaccattattgcaaatatgtatttaatttttggatggacaccatctataaatgatattgcagtaaattcctatgaaaatattaatgatataaagagcatagataaagaggagataccagaagaagtatcattttattttaatccagatgaagggatagaagccttagacgaaagtgatgttgaagaagtgaatactactttaaaaaggttatcaactagcgatctatctaagtggagtgaattgaagaatgataaaaataatgataaagttatggaattctttaagttaattaaaaaaagaatgacatcggatgattatgaaaagataaagagtgttataggtaaaatcattgatgttgacagggttgaagtgcaattagaaaataattatgtttagtgttgtaaaattgagaaaaatagagaaaataatagaatagtgattgtaatttattttaaaggcataaaatgatagttgaaataaaatgcctttgaatatatactagtctttgtcgagcggtgctgacgaagcaaagcaagacagaatgaaaaaaataaattatatatggaggaattcccgagtggccaaagggggcagactgtaaatctgttgcgttagcttcgatggttcaaatccatcttcctccaccaattttaatgggcgcatagctcagctgggagagcacctgccttacaagcagggggtcacaggttcgagccctgttgtgcccaccattaaaaataaaatatatgctggcatggctcaacggtagagcagctgacttgtaatcagcaggttgtaggttcgattcctattgccagctccatcaaattaaggaggaattcccgagtggccaaagggggcagactgtaaatctgttgcgttagcttcgatggttcaaatccatcttcctccaccaattttaatgggcgcatagctcagctgggagagcacctgccttacaagcagggggtcacaggttcgagccatgttgtgcccaccattaaaaaaataaaatatatgctggcatggctcaacggtagagcagctgacttgtaatcagcaggttgtaggttcgattcctattgccagctccattaatgaggaggaattcccgagtggccaaagggggcagactgtaaatctgttgcgttagcttcgatggttcaaatccatcttcctccaccaaagaataaactattgtttattcttttttttattacataatatatcttaaaatattatgtgatgatttttggaatattattttttatattatattaattaaatttagaaagactatgtttaaattaataatattatatagaaaattaatagttttaaagaatattttgatttagaaatgaactgataatgttcagctttaattgataaaaattaaaagggaaaaacatattgactaaataaaatggctatgctagaatacatattgaaaattgaattaagttactcttatcaagagaggtggagggatagggcccagtgaaacccggcaacctgtatatacaaggtgccaattcctgtagatgtaattctacaagataagaaaaggatttttaaagttatactcttcttatcgaagagttttttatttgtttaaatttctgtaaaaagaataatttaaagtttttttctaaattttaagatataatctataagctttgctattttttaatattaaaaaatgttgaaattagcaaatggcaatgagaataattttgataaagagtacacattgaagggagaaacagatatgagaagattatttacttcagaatcagttacagaaggtcatccagataaaatgtgtgaccaaatttcagatggtgtattagatgccattttagagaaagatcctaatgctagagtagcatgtgaaacatgtacaactactggtatggtaatggtaatgggagaaatatcaacaaactgctacgttgatattccaaaagtagttagagaaactgtaagagaaataggatacgatagagctaagtttggttttgactgtgatacttgctctgttatgacaacaatagatgaacaatcagcagacattgctcaaggtgtagatgaagcacttgaatcaagacaaggcgaaaaagataatgttgaagctgtaggagctggagatcaaggtatgatgtttggttttgcaacaaatgaaacagatgcatatatgcctttacctatatacatggctcataaattatcaagaagacttactgaagttagaaagaattctacattaagctatttgagaccagatggtaagactcaagttactgttgaatatgaagatgaaaaaccagtaagaatcgatacaattgttatatcaactcaacatgatgaacatgtaacattagaacaaatagaaaaagatttaaaagaatatgttatcaaagcagtagttccagctgaattattagatgaaaaaactaggtattttattaatccaacaggaagatttgttgttggaggaccacaaggtgattcaggattgacaggaagaaagataattgttgatacttatggtggatatggaagacatggaggcggagctttctcaggaaaagatccaacaaaagtagatagatcagctgcatatgctgcaagatgggttgctaaaaatttagttgcttcagaagtagcagataaattagaaattcaattagcttatgcaattggagttgctaagccagtatcaataactgtggatacttttggaacaggaaaattaagcgatgataaaatagttgaaatagttgaaaaagtatttgatttaagaccaggtgctataataagagatcttgatttaagaagacctatttataagcaaacagctgcttatggacactttggaagaaatgatcttaatttaccatgggaacaattaaataaggttgaagaaataaagaagtatttataatatttatcaaaaatgaaagcactatcatatgatagtgctttttatttttgatattgaaattaccaatttaaatatagattaaaaaattctttagaaagttgttacaaattatgacatgatcattggataatatatatataagatttaaaatggtataatatctttatgatataataaaataaatttataagtatgaaaaagtagattaaaaatattaattatagacaataataagagttaattaaaagatgtggagagattctatggaagtccttaatggttttgttgaaagtatcgtatttaaaagtgatgatactggatatgtggtttgcaaaataagatgtgataataaagttattagtgcagttggaacagttccttttttaaaggaagggcaaaatgtaaaaattactggatattggacagtacataagcagtttggaaatcaattcaacattcaagagtatgaagaaataatgccaaattcattagatggaattgaaaaatatttgagcgcaggtgttatacatggtatagggcctgttacggctaaaaaaataatagccaaatttggtgaggaaactcttgatataatggaaaatagtattgaaagattaatggaaattgaaggcattggagagaaaaaatttcagataatttatgaatcatatattgaacagcagggtcttaaagatataatattatactttcataagcatggagttaccaataatcagtgtataaaaatatataaaaaatttggtcctaatgcaaaacagatagtatcaaataatccatatatattatgtgaagaaatatctggaataggttttaaaacagcagatagaattgcaatgagtataggtatagaaaaagattctaactttagaattcaaagtggaataaaatacataatgaatcaatattgtgctgctggaaatacatatatgccaaagaagagtgttattgaagagtgtgaaaaaaatttattgataaccaaggaattaatagaaaaaaatatttatgatatggctgcaactcagaaaatagttgtagaaagtgtaaataacgaagaggcagtttttttacttcaatattattattgcgaacttggtgttacaagtaaaatagtaacattagggcttcaagatattcctactataaattcagatatacaatttgaaattgatgtatttgaaaaagagcagaagataaagtttgcagattctcaaagagaagcaattcttggtgcttttaacaatggaatagaaataataacaggaggtcctggaactggtaaaacaacaataataaaagctataatacacatttatgagaataatggaatgaaggtaatattaggagcaccaacaggaagagcagctaaaagaatgactgaatcaacaggtcgtgaggcaaaaacaatacacagacttttggaaatgggagtttcagaagaggatgaatctgtttttgaaaagggagaatcgtctccgttagattgtgatgttattattatagatgaagcatctatgattgacattatgttgatgcagagtcttcttaaagcaattaaattaggaacaaggcttatagtcgttggagatgttgatcagcttccatcagtaggtgctggaaatgtgttaagagatttaattgaaagtgaatacattaaagttgtaaggcttaaagaaatattcaggcagggaaatgaaagtcttatcgtagttaatgctcatagaattaatgaaggtaagatgccgttattaaatcagaaagataaggattttttctttataaatggagagaatcaagatagaattgtagaaacaataaaagatttaataaataggcgacttccgaagtttaataggtcatgggatagattgagagatatgcaaattcttacacctatgagaaaaggaacgttaggtgtaataaatttgaataatagtcttcaagaaatgtttaatcctccagagaaagataaaaaagaaaagacatccagagatcttgtatttagagaaggagataaagttatgcaaactaaaaataactatagtcttaaatggtttagagtttctggaagtggtgaaaatgaaggcgtaggagtttttaatggagatttaggatttatccaaagtatagatgaagaaaaaaaagctatgactataatatttgatgatgaaagaaaggtattgtatgattttagttttttggatgagttagacttagcatatgcttgtacaatacacaaaagccaaggaagcgaatttaaagttgtaattataccggtattcatgggatcaccgtttttaatgaataggaatcttctttatacaggtattacaagagctaaacagcttgtagttgttgtaggatttcagaaggcattaatgtatatgataaataatacaaatagtatggagaggcattctgctttaaaatatagaataacagatataatatctaaggatgaaattgaaagtggctttgaatatgaactagatgaagaatttcaaaaagggcttgaagaatttgaagaagagaataatgaataggagaggagataatttatgggggaatatgtaaagtaaataaagaagatttaaaatatgcaatacaaaaaatagattactggtataagaaacatataaagtttttaactataattacagttccctttaatacagcgtgcatcttttcggacattattgataaggcttctaaaaatggagaaagagtgttatatgtttggggaaaagaacgagaaaatagagaacttgttaattctatacgagaatttaattcacagataacatattcttattttaaagagtcggattctaactctcaattaacatttgtaaattataatagtttaagaaatttaaataatcaatatgatttagtaatttttgatgatataacatacttctcaaatatcagtaatgaaaaactttttgaatatgtaagagaatatgaaaatatgggaaagaggattatagtttataacatagaaagacttccaataataggagaaaaaatagaactttcggcatataattatgaacaaccatttgtagaaccaagagttatgaccacaaggatagatttaaatatagatattccatatagtttatatgattatataaactggtttaaagataataatcataaagttgctatattagttccggataaagaaaaggtaaagctagtatatgaatactttgaacataaactgagactgtcagaagtgaagataataaaaattttagaaaaaaatgaaatgaagagacttgaacgtgtattaaaatataaagataagtcaatatttataataacaaatcagagtgaggagttattagaaaattgttatatagatgatgctgttgtgatttttgcggataatatattttttaactataaaaaaatactgtacatctgtggaggtatgagaaatataaactataatattccagaagttttacttgtatctaatagtatatctgaggatattgacaaagcaaaagatatagcaagacaatttaataaaatagtatgggaaaaaagtctgaaacgtttataaaatcaattaattacattttaaaaggaatacttgaaattatatatccaagagaaagtcattgtataatatgtggtgaagaagattcaaatggtctttgtataaagtgtagaaatagtatttcaagggtaaataataaatttaataatagtattgatagttatggttattatggtggagtattaaaagagttaatattaaagtttaaatattatcataattttacagcaggagatattttgtcagaattattagaagaatatattgaaagtgaatttttatataaggacttcgttattacatatattccattatcaaaaaaatctaaaaaaaagagaggattcaatcaatgtcaatatcttgctgctaaaatagccaatgatttagagataagatgtatggaagttctaattaagaagaaagaaaataaagagcaaaagctacttaaatataatgagagacatgaaaatgtaaaagatatatttgagttaaagagaaatgtaaatattaaagatttaaagtttataatcatagatgacgtaacaacaagtggtgcaacaatagaagaagcatgtagaattttaaaaaaatatggtgtaaaacatataaaactattgaccttagcgaaaagtcatatataatagtaatgtaaagctaggtttgtggttgaaagtcgatgccagtcgcaggcaaaacgatccacgtaatttagacaaaatgtctaaggagcatggtgcggtatagaagtaagtcctgccagttaaatctgagagggttagtagtgaggaattaatttttagtagcgaaatctccagcaggcgagtgtggggtcaaagaccaggtcaactagctttactttttttatacataaaatattcagaatttacagaaaattctcttgttaaatatgatgaaaagtgttaaaataaagttaacataaaaaaccaaaacttaataaaaactttttcacatagagaggggctggcaataatgaaagtcacagttatagcaaaaaatattgaactaacacaagcattaaaggagattgttcaaaaaaagataagcaaattggaaaagtattttgaagtagaagttgaggcaaaagctacacttagtgttcaaaaaaatagacagataatcgaggtaactataccttttaatggagctattctaagaagtgaagagtcaacagacgatatgtataaatcaattgatttagttgaggataaattagaaagacaaataagaaagcaaaaaacaagattatctagaaaaaataatggatcattaaaatttgctgcacttaatgatagtaaagtagaatcaaatgaagatgatgaaggaagtttggttaaagttaaaaaatttggagttaaacctatggattcagaagaggcaatacttcaaatggatttattaggacataatttctttgtttatcaagattcagaaagcagcaaagtaaatgtagtttataaaagaaaagatggaaattatggtttgttagaacctgaattaatataaaatttatataattaaacaaagctgatggtaatgaaattcaaatttcgtaccattagctttgatttttgttgtaatatataatggttatattaaaaacattaattaggattttttaaattaagagtaaatttgtcacagtatagacataattataatatatacttataaattagatgttaaatttcaaaaatatgtgctatttagcatattattaactgatgaatatgaagaaaaatacgtacttttattgaaagttgtgcaattaaaatggtataatttaagaatgtttattatgataataaagcaatttcaatgaaaatatatataaattgagaggatgacattatgggattattaaatgccttatttggaacatacagtgaaagagaagttaaaagacttaagccttcaatagaaaaaataaattctttggatgaatcaatgcaaaaactttctgatgaagaattaaaggctaaaactgtagagtttagagagagattaaaaaatggagaaacattagatgatattttaccagaagcatttgctgttgtaagagaagcttcttcaagagttttaggaatgaagcattacgatgaacagctaatgggtggtatggttttacaccaaggaagaatatcagaaatgaaaactggtgaaggtaaaactttggttgcaacattaccagcatatttaaatggattaagtgaagacggtgttcatatagtaacagttaatgactaccttgcaaaaagagatgctgagcaaatgggtgagttatatggattcttaggattaacaacaggtgttattatacatgatttaaataatgatcaaagaagagaagcatatgcatgtgacataacttatggaacaaacaatgaatttggatttgattacttaagagataacatggttatttataaggaagaaagagttcaaagaccattaaattttgcaattgttgatgaagttgactcaattttaattgatgaagcaagaactccacttataatatctggtcaaggtgaaaaatcaactgaattctataaagttgcagattattttgctaaaaagcttgttgcagaaaaagattttacaaaagatgaaaaagctaatgctatacttttaacagatgaaggtatcaaaaaagcagaggctacatttaaagtagaaaattatgcagatgctgataatttagaattacaacattatgttactcaagctttaaaagcaaattttgctatgagaaaagataaagattacatggtaaaagatggagaagtaataatagttgacgaatttacaggaagacttatggaaggtagaagatactcagatggccttcatcaagcaatagaagctaaggaaggtgttaagattgcaagagaatctaagacattagcaactattacattccaaaattacttcagaatgtataaaaagttatcaggtatgactggtactgcattaactgaagaaggtgaatttagagaaatttatggcttagacgttattgtaattccaactcatagaccaatagcaagaatagataatccagatttagtatttagtactgaaaaaggtaaattcgaagctgttgcatcagaagttgctaaagcttatgaaaaaggtcagccggtgttagttggtacagtaagtattgaaaaatcagaacttgtatcacacttacttaagaaaaaaggaattccacatcaagtattaaatgccaagttccatgaacaagaagctgaaatcatcagtcatgctggtgaaaaaggaatggttactatagctactaatatggcaggtagaggtacggatattaaacttggagaaggcgttcttgaattaggtggacttaagataataggtactgaaagacatgaatcaagaagaatagataatcagttaagaggacgttcaggtagacagggagataaaggggaatctacattctttatctcattagaagatgacttaatgagaatttttggttcagaaaaaattcaaggtgtagttgaaaaactaggtcttcaagaagatgaagcaattgaaagtaagatggtttctaaagctattgaaaatgctcaaaagaaggttgaaggtaataactttgatataagaaagacattattaggatatgataatgtaatgaatattcaaagagaagtaatttacaagcagagatcagaagttcttgagggtgaggatgttaaggaagaaatcttatcaatggttagagaaataatcagtaaagctgttaatactcatattacaggtgaaagtgataattatagagaagaattcttacacttaatggtttatttacaagacatgtgtataccaccaaatagcgttaatttaccaagtcttgaaaatatgtcaaatgaagagatttctgatagtttatataaaacagcaattgatttttatgaaaacaaagaagaagaatttacttctgaaagattaagagaaatagaaagagtagttcttttaaaagctgttgatactaagtggatgaatcatattgataacatggatcatttaaaacaaggtattggtttacaagcatttaaacaaattgatccagttcaagcatattcaatggaaggtagtgaaatgtttgataatatgatcaatgaaattaaagaagaaactgtaagattattattccatgttaagattgaaagagcacctgaaagagcaagagtagctcaagaaacagcagcagttcatgctgaaagtcaaggtgcaggacaacaaacaaacaatggtcctattagattacaaactatggtaagatctaatgcaagaccaggtcaaagtggtcctattcaaacaataaaaccaggccaaggtggtccaggtggagttatggcaccaggttcaggagattcagcatcagcagatgaatctaatggtgaaaatccatatgaaggtttaactcatccttctcaaattcctgttagaaatgaagaaaaacatggaagaaatgagttatgcccttgtggaagtggtaaaaaatataaaaactgttgtggaagagaagtttaatcaattaaaagttaacaactaatggttaagcagtttgtgataaaattcttacagaatttatattgaataaatttctaataagaaatcccttttgggatttcttattttatttagcaaataaatttatagatttttatatagtaagtaatataaacaggctttacattttataattaaagatgaacttttatattggttgctaatttaaaaaatatgatataatatttcttaaagaaaaagaaagaggtgacgtggatgaatattgaattagaaaaagaattatctaagctttctaacttaaaaaaatctatagatgaaatgggggcttcactttgaccgtgcaggtttagaaaaggaacttcacgaattagagtgtaaaatgcaggaaccaggattttgggatgattctaaaaaggcagaagaagtcacaaagaaaagcaagcttataaaagataagattgaaaattatgataaactaaaatcacaacttgatgatatagaagtattaaaagatattatggaagaagatgatattgagtctgctaatgaaataatacaaacaataaagtcaatagagcatgagattgaagattacaatatgaaaatactactatctggagaatatgataagaataatgcaatagtaacgcttcatgttggagttggtggaactgatgcaaatgattggacagagatgttattaagaatgtatacaagatggtgtgaaaataaaggatattctgttgaaactattgacttaattgcaggagatgaagcaggaataaaaagtgttacactaaaggtaacaggtgagtatgtttatggatatcttaaagcggaaaagggaatacacagattggttagaatatctccgtataatgcaaatggaaagagacagacatcatttgcatcaatggaggtattaccggaactaacaaaggaacaagatataactatacgccctgatgatttaaaagtagatacttatagatcgagtggttctggaggtcagcatataaataaaacagattcagcagtaagaataactcatattccaacagggatagttgttcaatgtcagaatgaaagaagtcagttttcaaatagagaaactgcaatggaaatgttgaaatcaaaacttgttgaattaaaagaaagagcacataaagaaaaaatagaagatcttactggtgaacttaaggatatgggatggggaagtcagataaggtcatatgtatttcatccatacagtatggttaaagaccataggacaaatgttgaaacttcaaatgttaatggagtaatggatggagatatagatttgtttataaatgcatttttaaagcagccgaattaaaggaaatatgaacatagtttaatcatgataagatgatataaactatgttcatatttttattagcattcttttgagcgtttaaaatattttaacaattttttgttattttttatagtaattatggatatgaaaataattactactataaaagtaatggattgattatataatattaaaataaacttgttataagaagagttataaatttctttttgtactattgagtatacatgatctattgcacttgaatcaatataatcaattttatctgtaggtgtatgaatttttgacaaatctgaatgacatatagtaatagcatctataccttgattattaaaacttgcatgatcactggaatcttgaatttttacatcatatttcaaattgttttttgaacaagcatcttctaaatatttaagtgtattagaagtattttgatctttcagttcttttgcagaagttccaatgacaaatgaaataggagtatttggagcaccaatcatatcaaaattaataacatcagcattttttatttcatttaaatgtttagaaacaaagtttttagaacctagaagtccgaattcttctccagttaaggcgacgaatattatatcacgttgaggttttactaaagatgataaatttttagaaagttctaataaaaaagaagttcctgaagcattatctaatgcaccgtcataatagttaccaagagaatcaactcctatgtggtcataatgagcagttaatattagtggaggtaaattatcagactttcctttaattatgcctattatatttgatgttggtttaatagtagttgtataaggaatctgtactgaaacattacaattatttcgtaaacaatctaagatatcattatataattgggttgttatgtttatgcagaattcatactctgagttgcaattaaatgaactacggaaactaaaatctttagttggatttactttaaataaatattttttattattttgtgtaataattattgatgaagtaaggatttcaacattatcagatttggtaaacgtagcttctgaacttttaaaactaagcatattttctttaaaatcagtaccatatgaatattcatgaatcacttttccatttgaagtaataataatatacggagtttttttattaggaataggggtaacaacatcaaatgattctttataatttgaatttataggttttaaattcaaagtcttaaaagtattttctatatatgaagaagcagcatcacaaccaggagatccagctaatcgtccttcatattcatcagatgataatatttctatggtgttttttacattttcagaattaaagttatagagtttgaattgtaaaaaaaatgaggtagaaatataaattaatattaatagtaaaataaaataatatgttgataattttttttcattattaagtccttctataataaatgtttatattaatatttattaagtaaagattgtaaatatgatattaaatttaatattacaaccataagaattaatattgtaagtatactgaaaataatagaagatcaagtactaatgttttaatttgtacttgatcttttattaataaaaaatatattataaattttactgataaaatcataatggtttataaaacatgtctatcattgagtatatagcagataataccatacaaatataaataaatatatttaatcctggatttattatagacataataccaccagcaacaagacaaagcataatagatacgcttaaaaatttaaaaaatccagatttgtttgtcaagagagttataacagaagaaagcataattaaaagtattcctaaaaaatagaatatattttttaggatatcagagtaggtcataatttcaaattgatttaaaataagtacaagaaaaagaaatagtaatacaaatgaacatattttacttatatttttaatcataatttcaccatcctaacaattaaatggaaataatttacataataattatacagacatattaaaatataatcaaatagcaaattattgtgcgattaattataaagtgacaagatggcaaatttatttacctatgtatgtacacttgttaactgaataataataaattgtggtaaaatgtatataattaatgtttgtgaggtgtttttttgatgaatattttgattgcagaggatgagaaagacattagagaccttatctcattacatatgaaaaaggaaaatcataatgtttttgaagcaagtgatggaaaagaagctttagatatttttgaatgtgaaaaaatagatttaatattagttgatataatgatgcctaaaattaatggaattgcagttatacagaaggtgagagagagttctactataccaataatatgcattacagcaatgggaagtgattcagataaagtacttgcgctaggaataggtgctgatgactatttagttaaacccataagtcctatagaattatgtgcaagggtatcatctcatcttagaagatgttataggtatactgaaaatagggaagatacctgttctactggagatttaaaaatatattcagacacctttgaagtttacaaaggagataaaaagatagagttaaatcctaaggaatttaaaatacttaaattattaatatcaaatgcgggacgagtttttacaaagaaacaaatttatgagcaagtatggggtgagatttatattggagattcaaacaatataatggttcatttaagtcatataagagaaaagatagaagatgatcctaagaatccagtgtatataaaaactataagaggaatagggtataagattgaaaggtataagactaatgaaatctaagaaacgtgtaagaagtgttacaacagaaatgttttttgtatattttttaggatatataactatttcgataatacttattcttgccattcatttatcttttaagttttatgaaatagcttgtagtagacgtacatataacagggaatactttgaaatgttagaaaagaaaattgaaaacgactatacaactattacagaggaagatcttaaaatgattaatggatttattgttaaaatagataataatatcagagttcaatatgcaattggatatattgatgaaaaaaagtttgatgatataaaattagaggattgtataagtttactcggatttaagaccaatagtgaattcaaagtaagaccacctgatattctttcaagaaatatttttaaaaattgtaataatgctattgtaactgttgatgaaggtgaaaaatattcaatatatacaagatacatgcatgaagataagtcactacttgttttggggtgcccttattcagaaataacaaaatctaacttagtgactcagatacttccacatcattatatagtaaaaggacttgcattttgtaatgtgatgattgttttatgtattgtatatattcttgctcaaaaaacttcaaaggaatttataaatcccataaggactctccttagaggggttacagaaatagctaatggaaattacgatgttagagttgaaagtgaaaaaataaatgaatttttagaattaactaatggttttaataatatggctcagacaatacagaatgagcaaaaggaaaatagaaagcttgaaaaaatgagagaagatttaattttagatatatcacatgatttaaaaaatcctcttgcatcaataatgggttatagtgaaactttaataaattcagatgatttaaattctgaagagatgaaggaatatcttactataataaatagaaattcctatagagcgaataagcttattaatgatttatttgagttttctttatataacaatactgactatcaatttaatcttgttaaacaagacatttgtgaagtattaagacaaataatagctaattttattccagagtttgatcataaggaattcatatatgattttgaaatctttgatgaaagttattatgttatgatggatgaagaaaaattatatagagctatcaataatattcttgagaataaagtaaaatataataaagctggaaatgaaatttttataaaaacagaaattattgatgataaattttatattagattttttgataatggggatacaataccagaagaatataaagaaagtatatttaatccatttgtaagaactgataaatcaagaaattctaagactggtggaacaggacttggactgtctataacaaaaagaatactaaataaacataatggtgatataaaaatactagaaagtgaaataggaactaactttgaggtatatcttcctttacttagagaatagctgaagaagttaaaatatgaaaataatatttaaggtatttttaatgttacaacaactattaattaatacgaattaaatataattattattataagtacagatttcagaataataatattggtgtttacggaaaagggtagaggaggtaaagtattggatttaaataaaagattaaatcaaataaaaataagggatattattattatttatttatttagtacatttatcgttagtggaataatatttggtattgtaaaaattaatcaaaaagaggttgaaaattttattttaaatacattaactttaattttacagctagtagtactgataatattagtattaaaaattaagttatcaaagcaagatataatgttcttatatgaggattttaagaaaaagatagataaaagagaactatttaatgttactttcattaagatatgtatagcattaggtggaggtaaattaatcataagttttctttattttattgatccaagcatagtaaataattttatttatgaatcaagttcattgataaatacatttagaaattatctattaaatgtagtactactagtgatgatagcaccaattgtagatgagattgtttttagaggtgtgatattcaataggattatacaaaaatttaatttgtgcgttggaataatcgtatcatctataatttatgcatcattttatgctggaagcggaattgcaggtgcttttgctttagggataattaattgtatattatatattaaatatagaaatattttaattaatatttttgtgaattttataaacaatgttattgttttaatttcagtattaccggtagttaataaaaatgtaaatgatatgataataacgtacagtaatgtaattataaatatttttttgggaagcatattttgtattggtggaatttatttattaataaaatttataaataaaaatagtaatgtcttaatttcatatgataaatatgtaaaagcacataaagaattaaatataaaaacttaaataatagtttgatgttttcttgatataattataaaattaagtctataatagtatataaggttatttattgccattacttataaagtaatggcaatattatttgtataaagataatatttaaagttatattttacaattttatgcaaataatataagtgaattaatcaaaatagaggataaaatgggaggcaattatgaattctatagaaaataggttagctgaggagctaggaataaaattaagtcaagttcagaatgtaataggacttttagatgatggaaatacagttccgtttatttctagatatagaaaggaagctacagggggactttcagatgaaatattaagaaagttatcagaaagacttacttatttaagaaatttacaagaaagaaaagcggatgtaagaagacttatagaagagcaggaaaagtttacagaagaaataggaaaagcactagaaaaagcacaaactttaacagaggttgaagatatatatagaccgtataaacctaaaaagagaacaagagcaactattgcccaaggaaagggattggctccattagctgaacttattaaagaggggaaatttacaggtaatatagatgaagaagcatctaagtatattaatgaagaaaagggagtaaaatctgcagaagaagctatatcaggtgctttagatattattgctgaaaatatttcagatgaagcaaaatatagaaagcacataagaaaccttgtatttaaagaaggtaagatagaatcaaaaggaagcagtgatgaaccaactccttatgaaatgtattatgattattgtgaagatgtatataaaataccacctcatagaattttagcaataaatagaggtgaaaaagaaaaagtattagccgtaaaaatagttttaaatgaagataaatccataacttatcttgaaaacaatatacttacaggaaataatattgttgatgaaaaattaaaattagcaataagagattcatataaaagattaatatttccatcaatagaaagggaaataagaaatgaattaacagataaaggtgaagaaggggcaataaaaatatttaaagaaaatttaaaggcacttcttcttcaagcgcctataaagggaaaagttgttatggggtttgaccctgggtttagaacaggatgtaaaattgctatattagatgctacaggtaaattcttagaaaatacagctgtttatccaactcttcctaaaaaggatattgaaggtactaaaaagacactgaaagcacttatatcaaaatatgatgttgatgttatatcacttggaaatggtactgcatcaagagaatcagaagaagtaattgcagaaatgattagtgaaataaagaaagaaacagggaaagagctttcttatgttatagtatcagaagcaggggcttcagtatactcagcctcagaactagcaactaaggaatatcctgatttagatgttacagtaagaggggcaatatcaataggaagaagacttcaagatcctcttgcagaactagtaaaaatagatccaaaagcaataggagtaggtcaatatcaacatgatgtaacgcctaaaaagcttgaagaatcattggcaggagttgtagaagattctgttaatacagtaggtgtagatttaaacattgcaactccatcattattaacacatatatctggaattaatgcatcaatagcaaagaatatagttgattatagagatgaaaaaggtggatttatatcaagaaaagagcttcttaaagtaaaaaggctgggacagaaggcttatgaacagtgcgcaggtttccttagggtatcagaaagcaaagaacctttagataatacatcagttcatccagaatcatatgaagctgctaaaaaaataatagaggtacttggatacaataaggaagacttaaaaaataaaaatcttaatgatatagatgagagagcagaattaaaaggacttcacaaattaagtgaggaagtagaaattggagaacttacactaaaggatattataaaggaacttaaaaagcctggaagagatccaagagaagaaatgccaaagccaattctcaaaactggaattatagagatgaaagatttaaagccaggcatggttttagctggaacagtaagaaatgtttcggattttggtgcttttgtggatattggagtgcatcaagatggattagttcacaaaagccagatggcagatagatttgtaaagcatccattagatattgttaaagttggagatgtagtaaaagtatctattttagaagtggatgagaaaagaaaaaggatatcattaactatgaaggatatcaaagagtcggaatagtataattaattaaagtctggattaagtatttataattgaaagtattgacttaatccagatttttaatatatatttggaggatataaggtgaatagagaaaagttttataccaatagaagaaatattgttttattagctactttatgttgttttttatggggaagcgcttatcctgcaataaaaggaggatatgaattattcaatatatcaggaggggatattccaagcaagttgatttttgctggatatagatttgcattagcaggcataatagttctttgggttcaaatcattagtaaaaaaaatatttttgttttaaataaaaaagaaatagttcaagttacattgctaggaatatttcaaacaacattacaatatatattcttttacataggacttgcatatacaacaggaataaggagttctataataaatggaaccggagcattttttagtatcttattagcgcactttatttataagaatgatagacttaatgtgaataagattgttggatgtattgttggatttataggagtaattatagttaatttaaatggacaagacttttttgcaagttctttttccatccaaggtgaaggctttgttatgttggcagcattaattctttcagcatcatcaatttatggaaagaaaataactcagaatcaagatgcatctattgttacaggatatcaattatttattggtggattaattttgttattattaggatatatatcaggaggatgtttatctggttttacatttaaatctacaagcttactaatttatatggcacttttatcatcagtagcatttgcagtatggactcagttgttaaagtataataaagtaggaataatatcaatattcaattttttagttcctgtctttggaagtttgctttcagcaatttttcttggagaaaatatatttgatataaagatactaatatcattaattttcgtctgcttagggatatatatggtttataaaattaaataaagttagagtaaaaaagtttatcttagaattatataaaatgattttaagataaactttttttgtaaatattttattaaaagaatgaagcactataaataagatatatttttatttataatgttttaattgaaatataagcattttatatatataatatttatataaaataaaatatatcttcagggcagggtgaaaatccctactggcggtacagcccgcgagctattttagcagattcggtgtaattccgaagccaacagtatagtctggatgaaagaaggtaacctattaggaaatatgagttttttgtatgtttgtatttgtgccctgatgtttttttgcatcagggtttatttattttataggaaattatatatatgataatcaatgcgtacaaaatcataagcctgataagctaccctaagaagataattcagggaggcagattatgaacaataaaacaagtaagcttattaaaatttctttgttatcggcaatcgcactaatacttatgtattttgattttccggtaatccccatatttccatggcttaaaatcgatttaagtgatgtgccagcattgttaggagcttttggttttggtcctattgttggaatattaatagaattaattaaaaatttattatatttctttataaagggaagtagtatagctggagttattgctaattttattgttggatcagcactagttttaccagcaggatttatttatcatagaaataagagtaagaagaatgcaattgtaggaatggtagttggtctacttataatggaggttgcaggaatcctagctaatgtatatatattacttcctttatacggaatgcagatgtcaccagaagaattagctaagtatgttactgtgggattactaccttttaatggagtaaaagctgcaatggtaaatgtattaacatatttcttatataaaagagtatcagtatctatatttaaagcagaacctaattttggttcagtcacagataaaaaaacagtataaataaaaatttgtaaaataaaaatcttaatcctttaaaataagtaaggattaagatttttattttatattaatttattctaagccacattaataaagcattttccttattatcttgataatattcttttcttataccatcaattatgaaaccatgcttttcataaactgatatagcagctttattgctctctctaacttctaatgtatatgcagtacagtttttctcattacagtagcttagcattgattcgataagctttgagccaattccaagttttctgtaattagggtgtacagctacatttgttatatgagattcatcaacaataatccatgttccaataaaacctacaactttattatcaattttagcaacaaaatattttgctagtgaattgttcaattcttgttcatatgataatctgctccatggagatgaaaaacttagattactaatttctaaaacatcatcaatgtcattttcatccataatactaacatgtacattcattttttagttgcatcctttgttcatattctctttcagcttgaggtttttttaaataaaatggagtagagtttggatcatcacaaattccatttttcaacaatatgcttcctaattcacctagagctgatgcacgtacaagatttaaatgattaggtggaaaataagcgttaggacaatttttaattaaataatctttatatttatctaatccatctccaataaacattaccttttcattttttgattttagtaactctataagatcatctaaatccaaagcagagtagtctgtaagtttttcaagagatacaacttttgtatcagaattaatattagatttatataaagctgtatatacgctattccttaatgcatccattacaggacatataagaccgtcaaattcagatgcagaaaaagctaaggcatcaagacttgatatacttacataaggtttattactaccaaagctaagacctttaactgttgccattcctattcttaatccagtaaatgaacctggtcctttagaaacaacataaccatctatgtcatttacagtaagattattatattttaataaatcttcaataatactcattaaaacaactgaatgttctcttttatcatttagtgtaatttcgcttaataaattttcatctttcatcaaagcaacagtagctaccttggatgaagaatctatagctaatgtaatcataatttcagctcctttatataattatatctttctccataaggagttaatgtaatttttctataactttctcctttagaaaggtccttttctatataaatatgaagtaagtcttttggcagtatttcttcaatataatttgcccattctataattgagactgcatctgaaaaaatgtaatcatcaaatcctattgcataaatttcatcaggatcacttactctatatacatcaaagtgatttaattttaaacgtccactatcatattcattaacaattgtaaaagtaggacttgtaatgttatcatctatatcaaggcctctagcaattcctttagttatatgagttttgccagtacctaaatcaccagttaaacagactatatcacctggatttaataattttcctaattgtattcccagttttgttgtctcttcaacactgttaaattcaaatttcataaaatacctcctaggtataagatttacacaactattgttatgcattttcttattcttttattgtatatcaaaattctataaaagcaaattaaataatattttgggagtttttttttacttttatatatactacattaaaatgtaataattttgtatatatttatttgatattagttggtataataatataagatgttaactataaatattaataaaaaaatgagtataattaacttattaactaaaaagtactaaaaagcaatactaggaagtgtttatggtacaggaggtgctttccttgaaaaagattacttttgcaatggttataataactattgttttgtctttgggaatgagtgtattttcaagcccattattagctaatacagataatacttcaacaaacagagtagagagtagagatagatatttaaatataatgacagtaaataaaccacaatatgatatggtaaagaaaataaccaaggacaagcacaatgttgagtatatgtttactgaaggaaatgatataagagattttaaatataataacgaagttatagaaaatgtttcaaacatggatttatttatatattcaggtactagttttgaaccttggacaaatacttttatagatgaacttaaaaaagggaatcttggaataataaatatggcaagaggtataagacttttaaattatgaacaggatggaatcagcaaagaaaatccttattattttagtggtattgaagaatataaaatagcattatataatgcgaaggcagcaatacaagatagagatcctcagaatagagattattatgaagataattataatgaagctataaaggactttgaaaaaaggataaaacattatgatagaaaaataaaacagcttaatggatttacttttataacattaagcaatgattttgattatttattaaaagatcttggacttaacattgtaaagcttgataatcatgaattaagtgaatttataaaaataaataatttagatataaataaagtggtagtaattgaagatggagaaaagccatcaggtttagacttatcaccatattattcagttaaattatggaagtattatggaaagatgtcttttgatgatttgatagagtataatgtaaatgaattaagtaaatttgcaaaagatgaaccagcaaaggaagatagcaagtcagaaaagactagtgcatctgcacaacatagtcaaaaagtataatttttatatttatatttataatgattttatatcaaaagattaaatcattataaatataataaaaaatatgttgcattgtttgaaaatttagtatataataatttttgtcttaggggtatggctcaacggtagagtagtggtctccaaaaccattggttctgggttcaaatcctagtgcccctgccagaattgtcgtagcacgttgtgctacggctttttttatatttaaatataaatattgataaagttaatatttgataggattgagaatttataaaaaacatataaaccataatgtattgaaatttttgaatgtaaaataaataaaaagggtggttttatggacaagaataaattaaaagaaattaaagaacatggaactgagaattttccctgtggattttatttaaaaagcagcaataaagataaacttcttgtaaaacatcattggcatagtgaacttgaaatgatttatttaaaaaaaggtaaatatgttgtagaaataaatatggataaacatataattgatgatgaatgtttttgttttataaatagtgaggaacttcactatattgattcaacatttccgtatagtgaaagtgcagttgtttttgatttgaaaatgttgagttttgacatgatagattcaatacagatgaagcttatccaaccgatgcttaatggaaatttaaagcttccatcttttatacatattgagaatgatttttctaaaaaaatattacatgaatataaaaatatattaaaggcttttaaagatgaaggtcctctttcacaagaaatagaagggaatagggctgaaaatctttcatcgcaaataaaaattaaagcatcacttcttaatattttagcattgctatatgaaaatgagttaattgtaaacaatacttctgaaagtgaaaattataaggtagagtatataaaaactataatatcttatattcaaaaaaattatagtgaaaagatatatataaaagatatggctagacaaattaatatgaatgaacagtatttttgtaggtttttcaaatcaatgataggaagatctccaattgaatatcttaatgaatatagaataaaaaagattgaagaattgttaattagtacagacagaaaagttatggatatatgtcttgaatgtggatttaataatatgggcaattttataaatgtatttaaaaaatttactggaatgagcccaataaaatatagacaggaatttaagaataaaaagtcataataacataattttaaatcataaatacataagaaaaaaatataaaactcattaatatataattataggatttatattataagtaaaaataaagaaattattttatatattagggaggcaaattatgaatttatgtaaaggaaaacatgaggtgtttggaaaaataaaaaattatgaagttgatggaaataaagtaataatcaaatatgaaaatatagatgcaattatatcaattattagtgacgatattattaacttttttgttccgctatttagaaaagaaagaatttctaaagcggtagaaaatatagagttactaaaagatgatgaattaaattttgatataaaagagtttgaaggtaaaatacaaattactaccaataaacttatagtaaaagtacatgatgaatttatagttgatatatatgattctaatgaaactttgctatgtagtgattatagagaaaaatgtgatccatttaaaagaagatatggagattatcagcttgctgaagcagaaggacactcaacaagcagagattcagaatataaggtttatgttgcgaagaatatggaagaggatatgtatttttatggatttggtgaaaagacaggccatttaaataaaaagggatatcactatgtaaattggaatactgataatcctgcaccacatggagaaacttttgacagactttatcaatcagttccgttttttataggtttaaagaaagataatgcttttggaatattttttgataatcattttgagacacattttgatatgggaagagataattcaaaatattattatttttcagcagtagacggtaatcttgattattattttatatatggacctagtataaagaatgttgtaagtggatatacaactcttacaggtactatgcctatgccgcagaaatggactcttggttatcaacagtgtagatggtcatacgataatgaagaaagagttatggaaattgcagagaattttagaaaaagagatataccgtgtgatactatttacttggatattgattatatggatggatatagagtatttacatgggataatgaaagatttaaaaatccagaagatatgattaaaaagctaaaagaaatgggattcaaagtagtaactattatagatccaggagttaaagtggacaagaattataaaatttataaggaaggtcttgaaaataaatatttcgcaaccgataagaatgatattacttatgtgaatgaagtgtggcctggagatgctgtatatcctgattttttaaattccaatgtaagagagtggtgggcagataatcagaagataatgatggatgcaggggtaagtggaatatggaatgatatgaatgaacctgcaagctttaggggaccgcttcctgatgatgtaatgttcaataatgatgggatacccgttgaacatagagaggcgcataatgtttatggtcattttatggcaaaagcaacctatgaaggtataaaatcatcaatcaataagagaccatttatagtaacaagagcaggttatgctggtacgcagaaatattcaactgtatggacaggagataatcaaagcacatgggaacatttgagaatgtcagttccgatgcttatgaatatggggttaagtggaatgactttttgtggtactgatgtaggtggatttggtcatgattgtagtgcagagttattaagtagatgggttcaagtaggagcatttactccactatttagaaatcacgctgcaatgggaacaagagatcaggagccatgggcatttgataaagaaacagaagatattaatagaaaatatattaaacttcgttataaattaataccatatatgtatgatacaatgtggaaatgcagcaatagtggatcaccatttttaaaacctttattattcgattatcaaaatgataaaaacacatatgaaattaatgaccaattcatttgcggtgataatattttagttgcaccagtattagaacaaggcgcaaaatgtaggatggtatatcttccagagggaaatacatggatagattattggacaaaagaagaattcaagggtggacaatatataattaagaatacaccattagatgtatgcccaatatttataaaaggtggtactataatcccaatatgtgaagaacaaaattatattggggaaaaggaattaaataaattaacaatggaactttatttgagttctgataaaacaaatagtacttataatcattatattgatgatggagaaagctttaaatatgaaaatggagaatataatatttatgagataaatgttgaagaaaatgataacataaatatatctataaatatactaaataacaagtttaatgataattatgatagtatagaaataatgtttataaactggtctggtaaggatgtttttataaataatgaaaaaattaaagtggataataacagaatattaatcaacaaaagtaaattaaactgtgattaaaattaaaaaaataataaaaattgtggataaaatttataactatcttaatcattaagagagaagcaaaataatggattattttatttagctgttatataatatagtttataaaatatattattggggtgaagtttatatgttaaaagttacaaaaacagataaggctccagcagctataggtccatattctcaagctgttgcctttggagatttattatttacatcaggtcaaattgctttaaatcctgaaaatggagaagttgtaggaagtactattgaagaacaggcagaacaagtaatgaaaaatatttcagctatattagaagctaataatattgattttaataatgttattaaaactacatgctttttagctgatattgctgattttacaaaatttaatgaaatatatgcaaaatattttataagcaatcctgctcgttcatgtgttgcagttagagaacttcctaagtcagtattatgcgaagttgaagtaattgctcatatttaatttacaatagaacaaatatgttaatttataaaataaaaaattaccagaattgatttctggtaatttttttattttttatattatgtccaacaataaaacttattttattaggcattttttaactctgtaatgagctcatcaattaattccttaactgttgtcattttatttagtctatatgcattttctccacagaatataagaccttgatctatatctcctttaacagcatttataagagccttacttatacagtaaggagtatttgctgggttacaaggagtaaggcagttataacaatgagttattttctcaggtcctagagatgatttttttacaaattcatttctaagagctcttcctggcattcctacaggacttttaactatttgaatattatctttattgcaattaagataagcgttcttaaactcttgtgaagcatcacattcttcagttacaacaaatcttgtagccatttgaactccacttgctcctaatttcaaatagtgagcaatatcattgccatcgaaaactccgccaccaacaacaacaggaatttttttatcatatttttcttcgtattttcttacttcatctataacatcaattacagttttatcaaaatcaaaatcttcatcatttaattcatcaagtttgaaacctaggtgtccaccagctttaggtccttctataacaacaaggtcaggagctacattatcgtgcttatcccaaagtttaagaattacctttgcggcttttaaagaagaaactattggagcaatttttacatcatgtccttttactattttaggaagcattgtaggaagtccagcacctgaaattattaaatctacacctgcatctaaagcagctttaatatgttcttcataattatttgttgcaaccatggcattaattccaattataccgtttggagctttagattttgcaagagctatatgtttttttaaagaccttaagtttgattcaagtggatttttttcaaaatctggctcattataacctaactgagctgcggaaattatacctataccacctgagtttgctacagcagcagctaatttagatgaagatacacctattcccataccaccctgaattattggaacttcagcatttaaatttccgattttaagagaattaaatttcatttcacatatatcctttcgctaaataattttgattgttaaatattttgattatcaaactaattgtaattatattataaaataatctagtgatttaaacaagaaaaattatataataataatttatttataagaatatttagaagtttgggttatatttttcagaaaatcttaataaatttatattatggttaatgatgaaaaattatattatatagttgaatttgatagaaagtaatatatattgaaaaataatgttgacaactaatgtttaattatgataaaataacaaatgtcttaggggtatggctcaacggtagagtagtggtctccaaaaccattggttctgggttcaaatcctagtgcccctgccaaactagatcgtagtacagcttttgtactacgatcttttgttatttatttataaaaacattattataaaaaatttttaatatattaaattgtaattttaaaattctattctgttttaaatgaaaattcatattattaaatgaaaggtttaagattgtattaaattgaggtgtatatagtattactaaaaaattaacagtactaaagactcggcctgaaaataataatttttattttggaaatttagttattaaacaaattaaaaaatacaatattggtataataaatgcatattatggtaataatccatgatgaggtggaatacgaaatgaataaattagttttgctaaatgatataaaaaagagaaaaaagttaataacattaaacaggaaaaaagcaggtgtaaattaaatactattgagccaaaggattatagcaattttaaagaaaagttttgtggtcatatttcaggaaatataaaagaaaatactagtattatgaatcaagtaagcgatataataagaaagattttctttataaataatagattagttatagatttaataaattttttatatgatgattgcttaggtacaagtactgctataacttttgaagatttgtgtgattttgaaaaagatgattttattgtatcagtattagatgattatagagaatttaaatatagaataggaatacaatcatatgattgtaacaatatagcaatttatataaaaaaatttcaggtatgtggaaattatgaaaatgtagttaattttcaagtaaaaagaaaccagtataaaaaagcttgtgataatgaagataatactccagtaataaaagaaaataatgaatttaaagtactggttatagattcagatatagaggtcccagatttatttgaatataaaatagatagtgacaaaaaatctgaaatttatgaactcaatatttttaaaagttggaaatatgattttaaaaaattagcagaaaataaaatatatatgctatctcctttaaaaatatttgattttaaaaagaggcttaatgcattaaaacaagaaggatatacagaaaaatttttaaaagaagaaataggtagattctttaaagagataaatgcaccactatatagaatgaaagatagtgggaatataattgatgaggatattaaacaaataaacatgatagctatggagcttttatcgtgttttatgaaagacaagtgtcttgatctatctgatatataccaaaaattgccttaaaaaatcaggaatataaaataataagtcgggcaaaatactattgtcggcaggaggatttaaaaaaatttttctactgactaaataccaaattaaccgaggagggatcgttatgtcaaagagtgcattagttccagaagcaaaacaaggtttagcaaggtttaaaaacgaagttgctcaagaacttggagtaccatttaaagaatataatggagaccttagttctagacaatgtggttcagtaggcggagaaatggtaaaaagaatggtcgaagaatatgaacacagaatctaagcttagaaattgggtttaaattctaaagatattatgctatatacaaaagtataatatattattctgagatcgagaaggggctgtatcaaattgaaattttttaaattcaatttgatacagcctattcttataaacgtaaattttattcatgtatatatttccaaatattttattttgaaataacacaaataaaggataaacattattatccatattttaactatatatttaaaattacgaagcttgctgcttatgaagcagctcaccgttaagattttgaatggttttatggtacaatttattaacattataaccaaacgccattaacaaaaattcagtacgaactttaatatttccacgcataaaaaatcttctaaaaccataatcttgtttaataactccaaatgctccttcgacttgaattgatatgttcattcttaaaagtattcctttaggtgtagtgatgtttttaagtgaatttgttcttagacgcataaaatttttagccacatgtatttgtttattaccttttgctttcgtacatatactcttatattcacagccatcacagtcttcacattcatagatgctaacagtagtttcatatccagattttgtttttttcttttttgttccttttagaagcatttttttaccagatgcacaaatgtagtaatcttcatctgtgttatagtacatattttctttcttactaatatcactcttgaatttctttgtctttgacttttcataatttgcaggtttaataaaagcttcttgtttcttagattcaagatatgcataattttcttcactttcgtatcctgcgtcagcagttacggattcatatttttgatttaaattcttttctaatctatctaaaaatggtataaaagtaagctggtcagatctttcacttgaaatgtctactcctacaatatattcaccttctacccctatttggatattatatgctggttttaattgaccgtttttcatatgatcttctttcatatgcatgaaagttgcgtcatgatctgtttttgaaaaactgtttcgtccattaaaaatgctattgtattcattatatttattttgcttttcaataaattcattaagttgttcagtatatctttggaatttactttttcttttaccttttccataaacaaattcaatattattggcttcaatcataattctgatactatctaaaatataattagcatcttgaactgatattttagcattagtaataataagacataaattcaaatcatgattcatttttattaagctttcttttattttcttttgtagtctatcttcaaatttatcaatagattttttccaaacaaaagtatatcgatttgcagatgcttcgattttagttccatcaataaaaatatttttaaattgaatttcattaagttctctaagttttttcacaagttgattaaataaattttctatacaaccagctaatcgttcacgtctaaatctatctatagaattgtgtcctggtggtagttgaccttgtaaaagccatttgaaatttatatctcttttgcatgccttttcaagagcacgacttgaatatattccttccatatatccataaactataattgcaaacatagttttaggtaaaagtgctggatttctaccaatagtagagtaagttctatttaattctgaataatctaatccctccataacgtcataaagcactcttactgaatcactatcagatataatattttctatatttattgggaaacctatttgatgcataggtataatattattagtgttcatattgatattatgcgcaaaaaagagaattcaaatttatgaattctctttttttatcggctagtatcaaaattgttttgatacagccccttttttattaaaaaaaattatatattgaatccaataaaagcccatataatactaataacaatagcggctataatgtcttttggaaagtgtactcctgcaataattcttgataatccaataattattgctactataagcataaatagtccaaggtatacataattaatgtaaaaatatgatatggctataataaaggcgctagaagtatgtctgcttggaaaagacttaccttttccaggagtatattttacaagcggaatatgattaaatacatcataaggtctaggtctattaagaattttacgaagtaatgtaataaatataaaatttgttgcaggtattaataaaaatagaataagtttttcatttttgcttataagtagaatagctaaggtagcaaaatagcaaaaagcaactattaaaggtgtatacttgcataaatatattactgttttttctctaagtttagtttttctaaaatatgaagttatctttatatattgttgctcgttcattaatttctcctaaaaaatataatggttttaagatataaatattttatattatatcataggtaacaatattgataaattgcgaaagattagaaatacatgataaaattagaacaaaagttcgaaagatatttatagtgtatattacaattgacatttaacaatagataattaatttttaaatttataatgtacaaaagcatagtttaagataagaggtaaaaattaatgagaataaaaagtatatgtattattaattttgcgggattaaaaaataaaatgattgaattcaaagaaggatttaatttagtatatggagaaaatgaatcaggaaaaagttcaatagaaacatttataagaatatggctttatggaattaaagaagagttagaagatagaaaaaaatatctgcctttaagtggtgaaaagatttcaggacagttagttgttgaatatgatggaagggaaataataatagataggatatttggattagacaataaagaggatatatgtgaagtgatagatgcttctactggaaagaaaataaaagttacacatttaaaagaaccaggaaaaagtttattaaatataagctattcatcatatatgaagtccttagatattggacaagtacaaaaaaatacatttgatttcttatatgtaaataataagcatgataaatcagaattgaaggatactaaaaagaataaacttccttctattgaattattagaaacaatggagtatgaatgtgttaaatatagagaatttttaagtttgagaaatagaaaaattaatgatttggaagaattaaaaaaaataaatgatgaatttagtaaagatattagtctctataagaatattgattcaatgggagataatttactagatagaatatataaattaaagaatgatcaacaagaaattgagcgagaaataaataaatataaaataaattatgagtttatcaacaagactaagagggaacttattaagcaggatgctaatattgattgtattgaatttataggaaagtatagaggggaaatagagaatctccttcaatcttataaagatggattaaaggatttaaaatatagattagaaaaccaaagcaaacataagattgatagaaacactaaagacattaatagaaaaatcatattaactaatatagaactagtagttttatgtatattatttttattatcagtagttatgaaatatataccagggtcaatactttgtatagtattgtttgtttttttaataaaaagatattttaaatattcattaataattagaaagaataaaattgcaaagaaggatattgatcttattcaaaaagcaaaaaagagagttgaagatgaagaagaagaaataaatatatatattaaagaaaccaactgcaatagctatgaggaatttatagaaaagcttacaaagtatgataaatatataagctataagcataattatgaattggttttaaaagaaaaagaggctgaatttaatgaagagaggattaatactttgcagcatctttttaaggaaaaccaagatatattaaaattgttttatgatactttatcttgtagcaatatagatgaattagtagaaagaatagaaagatacgaaaaactaaaaatagatagatttaacattcacaaaactatagaagaaacaaaaaaatatcttctcaatattgaaattaatataaaagaaattgaaaaaagcatactggataaaaaaataattattgaagctgaagattattcaattgacaatttaattataaaattaaaagatcttaaaaagaaagttttattagaggaatcatatgatcatattaaattatttattggagatgaattaaatggtaaagttttaaaaagacttaacagattatcttcaatgaaatttgataagattaaaattgaaaagggaagtggaatagagatttatagttgtgacagattttatgacttaaataaattaagtagtagtactattagccaaatatatttagcattaagtctatctttttcagaaatgtttttcaaaaataaaaatgtaccacttctgttggatgatacatttgcacaatatgatgacagtaaaagaaaaaaagcactacgtcttttggtagaagaaaatttcaaacagattatattttttactagtcagattaatgacaagaatattttggactatataaatccatattatgaatatatagagatataaatgtaaaaaatagatgtaggtgtttatgttgacatttttattataagatagtaatatattatcataatgcaaatgcaaatcatatgcaaaaatggaggtagaaatgaaaaaaaagattatttcaggggctttggctgtgattacaagcataatgctcattggatgtggaacaaattctgatacaaaaactacaaatgatgaaggtaataaaaaagttaatataatggtttcggtatatccgttaaaggagtttgcagataaaattgctggagataaagcagaagttagctgcatggttcctgataatatggagcctcatgattatgaaccaaaaacaaaagattttgaagcattaataaaaagtgatgcatttatatataatggacttggccttgagacatgggttgatcaagtaaagagtgtaataggagataaagaactacgaattgtggattcaagtgaaggtgtagaagtaagaaaagaaggagaggttatagatccacacagttggcttagcttaaaagaagctgaaaaacaagctgaaaatattaaagatactcttgttgaaattgatgaagataataaagcttattatgaagaaaattatgatgcttttgtaggtgaattagaaagtttatataatgagtacaaagaaaaatttgataacttatcaacaaaagattttgttacagggcatgcagcttttggatacttgtgtagagattttggattgcaacaaaaatcagtagaaaacttatttgcagaaggtgaaccaacacctaagcaattagagcagttagtaacattctgtaaggaaaataatataaaaactgttttttcagagtcattagcaagcccaaaggtttcagaaactttagctaaggaagttggagcagaagtggtacctattttaactttagaatcaaatgaagatgataagagttacgttgaagcaatgagatataatttggaagagatatataagtgtttaagtcaagaataatttaacataaaaaataaaaccttcttaagttccatacttaagaaggttttattttcaaaattataattcgattaagtctttagatagctgtgaaatattaatagcttttcctataatttttattggaacattattttgatcatatataggagaaccttgaatttgccattttgtatagctattatcagaattttttattcttagtctataagaaatatttttacttccattattaaaatcattatatagatttataaagctttcaatatcatctttataaataacatcgctatttattaagttctctttaaaatttgagattacatgatcgttaccaaaaagtttttgacatacagtactgtttataagagtatcatttaagatatcatattcaaaatatatatcatcagatagtttacatattatttcgtaacgtttattttctaaatccaatttagatattgcatttttggggattgtaatatcagtaaatatgaaattatataaagatatattcttatttattgataaggtatttccacgagctgatatccaaattatttcactgtccttttttattatgcgaaattgtgctttaaaaggttgtccgttatctaactgaaatttaaatgatcttattactgaagtcaaatcatcaggatgaattaaaaattttgaattattcttatagtctctaaggaattcttctttagtatagccaatcattttataaaatttatcatcagcatattgaattgtaaatttatcatttccatatacttttgcaattccaccaggtacaatttttgttaaagaatcaaattcatcattttcctgttgagaaagttttttacttgaaattatatagagtatgaatataataaataataatagctgaaaaaaaagtgatatagtttttaaattatggctatgtattgaatttatacattgtaagtcataaaaagatagtaaaactataaaaattagtagtactattgagaggtatttgtatatttttaatgaatcatttctgataataatcatctccttactaattatggaatatatgtttagattataccattatttgattagatttcaaatatatagaaataattaaggagttaatagttaaatataaatgtaataataatgctttttatatagatataacttattcttaggtatatatatttaattttgtatgtatatatattttattttggttaattattaaattgggaggtgttttacttgaataatattgtaaaacaaaattatcttcaaatcttaaaaacattttttttaggattaatatttttggcaattggatcatttgcaggggtatatttaataccttattcaataaagagtatattgaatatagctttctttatagttgttttattttcaatgttttctagaaaaggtggttttataagaagtaaaagtagtatgtatatatatgcattaatacttggagtattgtcaggatcatcatatgtgtattatttttatagacttggaagtggattgtttatatcagtagttataggggttgtattaatttttggtatagcatatataatagctttaaggtcaagtgatgaaaatatttttagattagcaccatttgtatggggaggagtatttgcattatttattttagaaattttaaatatattcttatttagatttagcacatatactttggttatttctgccataggaataattatttatagtgtttatgctataattataatgaaatcaatacaaagaaattgtcagtatggggtattaagtgaacaagaaattgctatatttgcttattctatattcataagcttcttgaacttattacttgatttattaagatttgtttcaataattcagagtgacgatagatagaattgagtccctttaaactaatttaataactagtttaaagggagtttttgcgttgtaatatagttacaaaatatggaatttaacattgacactgcaaattaataacgtaaaataatagtagatagagaaaatatttaacattaagaaggaggagttatgaatcattctgaagagatttacaatagaaatataaaaattaataaagaaaaaagtgattcgttaaaagtaaaaataaatactgtaagcattataagattaggtatagtaattctttgtttattaactgattattttttgtataagaataataatgtaaatatgatgttattaataacactaatatttataggattatttttattttttatatattttcatgactcactatttaacaaaaagaaaaaaattgatctgttgataaagataaataaagacggattaaatcgagttaatggagatttaaataaaatagaagatggtggagaagagtatttagatgttaatcatcctttttcagatgatcttgatatatttggaaggaactctttatttaagattataaatacctgtgctacaacaggtggtagaaaaaggcttgcaagtattttgaaaagagatattacttttaatgaaaatgaaatattagagagacagaatgctataaaggaaatttctaagaagattgactggagacaaaaattaatagtagaaggtcattttaaagaagatgaaaatgataatatcgatgaatttataaaatggagtcaacaagagcagaaaaccaacagtacaataagtataatttcaacaatatttattgctataacaataatatctgtgtttgcagcattaaaaggtatagttccagaatcgtttatattattggatttaatggtcaattacattgttgtaaaaacaatgacaaaaaatttgaaaaatgaaatcaaattatttgaatctataaaaaatagtatgacttcatatagtaaagtactggaattaatacaagaggaaaagtttaattctggttatttgagtgaactacaaaaagaacttatttcaaataaaaatagtaagaatgtaagcgttgaagaattagattgcagattatcaatgaagaagctttctagtatttttagctggataggagatagtaagtataatgcatattactttataataaacataacattgttttcagatgtatttttaataagaagtatagaaaaatggaaattaaagaatggaaaaaatttaaaacaatggctagaggttatgtataaggttgatgagatgtgtagttttgcaaatctagattttgaacatgaaacttggtgttatccacaaatatctgttgataaagttataggaggagtgaatatagggcaccctttattaagcaaaagctgtattaaaaataatttctctcttaaagataataatactgttgcacttattacaggatcaaatatgtctggaaaaagtacttttttaagaactataggaataaatatgattttaagttatactggaggacctgtatgtgcagaaaagtttgtatgtggaataatgaacttatatacatgcatgagaacaaaagataatcttgaagaaagtatatcatcgttttatgcagaaattttaagaataaaattattaatagatgcagcaaaaagaggagaaagggtgttttttcttcttgatgaaatatttaaaggaacaaattcagaagataggcattcaggagcttccatattaattaaacagcttatagaatacaaaggtatgggaattgtttctacacatgaccttgaactatgtgatttagagaaggaaaatagtagtattataaattataacttcagagaattttatgaaaataataaaataaaatttgattatatattaagacgaggaaagagtgagacgagaaatgcagtacatctaatgagacttgcaggaatagatattaattagaggggaatataaatggggtacattatagtagatttagaatttaataatttaaaaaatataacaaagtattatgaagatttttttgaaaaaaatgctgatttgaaaagtattaatcttgaaaatgagattatagaaattggtgccattaaggttgataaatatatgaagcctttaggtgaaatgagagaatatataaaaccaactatttttccaataatcaatcctaaagtgaccgaaataacaaagatagatagcaatattcttgaaaaaaaggggattacatttgaagaagctattaataaattaaaagatatgttcgaagatggagatgtattgtgttcatgggctaaagatgatgtggctgaaataattataaattccaattatcatggatataaagatttaaattggcttgatagttatctagatattcaggaatatgcaagtaaaatacttgcacataaaaaagttcttggtcttaaaacagctcttgatgaattaaaaataagggtaaatgaggaaagacttcatgatgctttaaatgatgctttttatacagtggagatatttaagcgtatttataattcaagaataataaaaaatcatatagtgagagatatatataatatgccagcaattaatgtatctaatcttgaacaaatagaaatagatatggataagttacagtttaaatgccctaaatgcagtaggggtgtaaatttagaaacgtcaatagaacttttcaactggcgattcgctgctataggaagatgctcaaagtgtaaaaataatatcttgtttgagataatagtaaagaaaacacttcaaggtgaaatcggatataaggaaataagttctcaattaaaagaagattcttatttggattatatgtataaatttgataatataaaagagagaaaaagctgagaattatgctttatgaaaatttaatatataattaagaaaaatttacgaataagtaataaattccataaggaagttttcttaaaaatatggtaaaataaatgtataagctataataacgaatacatttaaggaaaggattttatttatgaatatagccttttttcttactcctaaaaatgaagtagtgtgtgaaaatgaagactcaacaatgagacaagtaatggagaaaatggagcatcatggatacactgcgattcctcttattaatagagaaggaaagtatgttggaacattaacagaaggagatttgctttggaagcttaaaaatactccggatttaaattttaaaaatactgaaagtgtcaaagttaaaaatattcaaagaagaatttctcataaatctgtatcaataacatcgaatattgaagggttaatatcattagcaattaatcaaaatttcgttccagttacagatgataatgggatttttataggaataattaagagaagtgatatcattaattactgctataatgaaatggaaaaaagaaaagaatatgaaaagcagcagtttgcattatatgatgaaggttaaaatagataagctgattgaatatataataaagaaaaatccctcttaagttatagagggaactttttttataagttttaactgtaaagcttattaaaattgtaacaaagaaaaaatgtaaacagtttacttgtataaattgttttcgtagattaatattgtaattaaggtaattaatttaagagtattatatttagggagtgatattaatatggcaaatgaagaaatattaaacagcatggatgaactgttaaaagattatgatgtaaaaaaacttaacagaggagatattttaaaaggaactgttatagatgtaaatgataaagaagtttctgtaaatataaattatgcttttgatggattaatatcaaaagaagaagtttcaagtgatgaaaaagatccaagagatgttgttgcaattggagatgaaattgaagtgtatgttatatctcctaatgatggggatgggtacgttgaattgtcattaaaaagatcaaaacagataaaggaaaaagaaaatataaaagatgcatttaaaaatggaaatattgtatctgtaaaaattaaagaagaaattaagggtggattagctgcatattatggaaacttaagggtgtttattccgggttctcttgcaagtagagaaagaattgaattaagtactcttgtaggtaaagaaatagatgttaaaataactgaattagatttaaataataataaaattgtagcatctagaagagttattgaagaagaagaatataacaaaaataaaaaagtaatatggaacagtttacaagaaggtgaaaagagaactggagttgttaaaaagcttgttaaatttggagcatttgtagatatcggaggagtagaaggtttaattcatctttcggatttatcatgggaaagagtaaataagccagaagagattgttaaagaaggggataaagttgaagtatttattggtagtgtagataaggaaaaggaaagactatctttaatattaaaggatattgctaaagaaccttggtctgttcatagtggagaaataaatgaaggtgatgttatagaaggaaaagttgtaagacttacttcttttggtgcctttgtagaattatttgatggtgtcgaaggacttgtacacataactgaaataactgatgaaaatattgcaaaaccttctgatgttttacaattaaatcaaaaggtaaaagttaaagtgttaagtatagatagggaaaataagaaaatgtctttaagtataaaagatgctgttgaaagtagtaaggaatatcttgaatatgtagataatgaagaagagggaacttctttggcagatttacttaaaggattcaaatttaattagtatcaataaataataaactccccgtaatatagcttttaagttgtattacggggagttttattatgatagtataattatagtttttctatttttaacatgttagttccgccagtttgagttgttggcattccagcagcaacaattatatcatcacctggttctgtaattccaagtttaaatacaacgtttttagcctcagttaatatttcatctgtagtattaaacatatcacattgcatagggattaatccaaagtttaagtttaatcctcttcttacatgatcataaggagtaattgcgataactggagccttagctttatatcttgaaagaagttttgcagttgcaccactcttagtagctgcaacaattgcttttgcatctaaaagatttgcagttctacatgctgagtagcttatagcagcagcgtaatctgttaatgatggttctctaaatctagcagttaagtgattgtaatctaagtattgttcagcttcttgagcaattttagacattgtttttgcagcttggatagggaataatccagaagcactttcaccacttagcattatagcatcagtaccatcaaagatagcattacagatatcactagcttctgctcttgtaggtaaagagtttctaatcattgaatcaagcatttgagtagcagttataactatttttcctgcttcattacattttttgattatcattttttgatttataggaactttttctattggaatttcaacacccatatctcctctggcaaccattacagcatctgtaacttctattatagaatctatgttgtctacaccttcctgattttctatttttgcaataactttgatgtgatttccgttattttcttgaagaattttctttacatcaagtatatcacttgcttttcttatgaaagaagcagcgataaaatcaacgcccatttcacatccaaatttaatatcttctatatctttttctgtaattgatggtagtttgataattacgttaggaacattaacacctttatgatttttaatttctcccccaacagtaactttagtatgaattttatttccttcaacacctgtaactttgaattttaatagaccatcatctactaatatgtttccaccaactttaatatcttcacaaagttctgtataagaaattgaacattgtgtttcatcaccaagtatttcatcaccacaaataaaagtaaagtcattaccttctttaagttctactccatcatttataaaattatgagttctaatttttggtcccttaatatcaagaacgatagcagtaggagagttcatctcacttcttaaacgtttgattaagtcaattttttctttgtgactttcatgtgtgccgtgagaaaaattcaatcttgctgcactcataccaatttcaataaattttcttaatgtttcttcgttatcactagcaggtccaatggtaaaaatcatttttgttttttgcataaaaacacctcacataaaaattttatagtatacttatattgtgtatttgattttgtacgaaatacatagaacataaaattctaagaaatattaattataatttaaaattttatgataaactaagaaaaaagatatatgaaattattgtaacataagtatttgatgaaagggtgtaaaaatatgaaaaaaattgaaaatgttaaatttgacagaattttttatcatttcgaacaaataagtaaaattcctagaggatctggaaatgaaaaggctataagtgattatttacttgatttcggaaaaagcttaggtttagaatgcatacaggatgcagcattaaacataattataaaaaaaccagcatcaattggatatgaaaatgcacccgctgtcattattcaaggacatatggacatggtttgtgaaaagaatagtgataaagaacatgattttgaaaaagatcctataaaccttgtggttaaaggtgattatatatatgcagataggacaacccttggagctgatgatggtattgctgtagcatatgcaatgactgttcttgaagataacgctatagaacatccagcaatagaggttttgttaacaactgatgaagaagctggaatgagtggagcaatggcgcttcaaccacattatataaatggtaaaattgtattgaatctagattcggaagaagagggaaaacttcttgtaagttgtgcaggtggaataagaactaaatcaattcttccaattgaatggattgataaaaaaaatgatactatagcatataatattgttataagaggattaaaaggtggccactctggcatggaaattcatcttggtagaggaaactctaataaacttatgggaagacttttaaaaaatatagataaggaattagattttaatcttgtatcattaaatggtggttcaaaaaataatgcaattccaagagaaagttcttctattattacagtatcacaaaaagatgagagaaaacttttagacataaagagaagagtatgtgaagaattaaaaaatgaatttagtaaaaaagatcctaatttaagagtacatcttcttgaggtagaagaaagtgttgataaggtattttcagatgattcaactaaaaaggctgtagatttattatatatgtatccaaatggagtaaatacggttagttctgatatccaaggattaactgaaagttcaacaaatttaggggttgtgactactcttgaaaacagtattgaatatgatagtactgcaagaagttctgtttcatcattaaaagatgaaatagtgactagaagcaaatgtataactgaaattttaggtggaaaattagtaacagaatcatcatacccagaatggccttataaaacagattcgaaaataagggaagtatgcaaggatgtatatgaaagaatgtatgaaaaaacaccagaaatagtagcgatacatgctggagttgagtgtggattattcaaagaaaaacttggtaatgatgtagatatgataagttttggaccagatattatagacatacatactccaaatgaacatattagtatttcatcggtagaaaggtgctatgaatatttattagaagttcttaaagaaataaaataataaatttagatagattctaattattaattgattttttgattatagttttggttactttgtgagtaatttataaagagttgaaaatatctaaagaatgttattgttttggtataaaaaatataagaattgatgttcaactgtagaatatcaattctttttttagaaaaaagaaagattaaaaagacaataattaaagaatatcgattatttaaaattttaagtaatactatttttgaaagtataaaatgataaagtttgattatactaaagggaaaatgctgaatttttaaattagcaatgttaatttgattaatattgcattatattcattttattaatgttggattattaaaataatataacattatttagagagaaggaataaaagtgaaaaaaagttctcagctgagaaaaatagcagtagtattatcaatttttgaaagtaatttatttttatttagtgttactggtgtaaaagctattgagaaaatttcaattgaaatcccaacaatatatgaaaaaagcaattttaaagattatagtatgtttagtgaaaagtgcttttcatatgaagcgtcagtagagtgtgataaagagttaaaaaatagagaagaagatattgtgaaatgtgcttatactcttatcggaaaaccttatgtttatggtgcaactggccctaatgaatttgattgttcaggtcttactcaatatgtatataggagtacaggaaaggatatatcaagaactacttatactcaggttaaagaaggtattgaagttaataaaaaagatcttatgccaggagatttagttttttttaacactaatggatacatgagtcatgtgggtatttatgttggtaatggagcatttattcacgctccaagaactggaaagcctgtaatggtaagctcattaaaagatggatattactgtgaaagatttgcaacagccagaagaataattaattaaatttatttaacataatgaatatatttgtaacttcatgaatatcatattgtataaaataaatagtttaaagaaataagctataggcaaaaaaacagtttttttatgctgacctatagcttataaatcagttggcatttcaaattagtagataataatttgaatataaagcataaacttataacttataactgttaactgataactatataatgggggtggtattgtgaggtacacaagatatgaatataaaaagcaaggaaaaataaagtttgtaatgagtgttgtccttgtagctacagtatctattggaagcggattatatataagtaaatttcttttttccacaaaggaaaccagtaatatgacacaagtaacacagaaacagaatgaaactgttcaaagtcaaggtataatggctcttcaatgtggatattactctaagaaagaaaatgctgatatctcaattccaactatatcatcatattgtcaaccttttgttgtagaagaaaacggtaattatagagttattgcaggcttatacgatgatgaactgggtatgaaaaagttggatgagcttaagggtaaaggtatagatgttgctaaagtaagtatacaaatacctaccgatactcttgaaggtaaaaaaatctttcagatagtggaaggttttttacaaattacaagcaagtttgaagaaagtgatgttaaaagtgtgaaaacagctgattttaaaacttgggttgatggtataattaatgatggaaattcaattcagtcagaaaagttaaaagatattcaaagttatgttcaaagtcttccagatgaaataagtaagtctaatagtgctgatagtgtccaaagtttatatacattaataaaaagttagtcaaaatcattgaaattattacaacaaaattacatttatataaaaaaatttataacttaatataacacacttgtttaagaacttcttaaatgataaactatagggtgtggaaatggttaatatgtatattttccatttttacaccttaaattttagagatatttagttaaaatattaacatgtctataatatatgttaaatgtcaataatatatattagattctttaattaggatgtgaacatatgaaaataatattagcttccgcttcagagagaagacaggaattattaggcagattagttgatgattttaaaattgaagtcagcaaatttgacgaagacactgttccatttgaaggagacatagacaaatatgttaaggctgttgctttaggtaaagcactagatgtagaaagcaggattaatgaagaagcaataataatatctgcagatacagttgttgtacagaatgataacattcttggaaagcctaaagataagcaggatgcatttaaaatgttaaaatcacttcaaggaaaaagtcattttgtttattcaggaatagttgttataaacactaaaactaataaaacaaagcaagaaagtttaggtacaaaagttactttttcagagataagtgatgaagaaatactagagtacatagaaacaaaagaacctttagataaagcaggttcttatgggattcaaggcagaggtggagtatttgttaaaggaattgaaggatgctattacaatgtagtaggacttccgcttaacaaattaaaatcaatgttagatgaagttaaataatttaggggaatggaagggatattaattttggagggataatattctatgaataatagcctaaacattagaaatataccggagtatgaaagacctaaagaaaaactattgacatatggtgcagaaactttaaacaattctgagttattagcaataatacttggaagtggagtaaaaggcgaaaatgctatagagcttagtaaaaggattttaaatgaatttgatgatttggatggaatacttacagcagattacaatgaaataatttcaattaatggaattaaatcaggaaaagcatctcaaattatggctttaagtgaattgtttaaaagatttaggactctaagagcaggaaaaagaaatataaaaataacttcaccaaaagatttagcagatcttcttatgggtgaaatgagttatttaaatcaggaggtactcaaggttataactttgagcacaaagaatacagttattgatgcaaaggatgtttttataggcagtcttaataactctattgttcatccaagagaaatatttaaacgggctataactagtcatagtgcttcagtaataatatgtcataatcatccgtcaggcgatccaacgcctagtagagaagacataaatataaccttaaggataaaagagtgtggaaagattataggaattccactaattgatcacattataataggaaataatacttttgtcagtctaaaggaaaagggactgatatagaattcggaaggggaaaaaataaaatgggattttttggatcaggaaaagacatgggaatagatttaggaactgcaaatacacttgtatttgttaagggaaagggaattgttttaagagagccttcagttgtagcaatgaataatatgactaagaagacacttgctgttggatcagaagctaagcttatgattggtagaacaccaggaaatattgttgcaataagaccattaaaagatggtgtaatagcagattttgatacggcacaaacaatgatgaaaaatttaatagaaaaagtatcaacaaaaaatgcatttaagagtccaagaatcattgtatgttatccatcaggcgtaactgaagttgaaaagagagctattgaagaagcaacaaaactttcaggggcaagagatgttatcttaatggaagagccaatggcagctgctattggagcaggacttccagtaagtgaaccaacaggaagtatgattgttgatatcggtggaggtactactgaagtagcgataatatctttaggtggtatagtaactagtaaatcattaagagttgcaggagatgaacttgatcaatcaataatctcttatataaagaaagaatttaacttaatggttggtgaaagaacagcagaacaagttaaaatggaaataggttcagcttacaagcttgatggagaagaagaaatgataatggaaattaagggaagagatatgatttcaggtcttcctaagattgttgaaatttcagaatcacaagttagagaagcattaaaagaacctgtatatcaaataatagaatcaattaaaactacattagaaaagacaccaccagaacttgcagcagatatcatggaaaagggtataatgcttgctggtggaggagcttatttaagaggattagatgtattaatcaataaagaaactaatatgcctgtacatattgcagaggcacctcttgactgtgtagtacttggagcaggaaaggcactagaagactttgataaaataagcagagaccaaagaggttaattaattaatgaaacttcttaagaataaactggcagtaactataatagtgctgtcagttacatttttagggttaattgcgtatacagtgaaaaaagaaaataggagcattattgaaagtggtgccggaagtgctcttaatcctgttcaaagattattgtatagtgcaactaatcaagtaaaagaaacattagattttttcttaaacttttcggaagtaaaatcacaaaacaaggaattagttgacgaaaatgaagatttaaaaaataaattagcagagtattccgatttaaaggaagaaaatgatagatttagggaaatgttgaatttcgcagaagaaagaaataattataattatataggctgtgatattattggatatagtggcggtagttttaatgatggatatatagttaataaaggaacaaatgataacattgctaaaggtatggttgtaataactaataagggtcttgttggccaagttacaagtgttggaagtaactggagtatagttcagactttagctaatgaaaatatagctgtaagtgttatggtagaaagtacaagagatgcgacaggatatctaacaggatacaaagatagtcagaatagaaatttagctaaagtatatgatcttcctatggattctgaggttaaagaaggcgatgttataatgacttctggtgtgggaatggtatatccaaaggaaataagaattggtgaagtaatatctgttgaagaagataaggtaaaagtaatgaagagtgcaattataaaaccgtatgtagacttcaacaaattagaagaattatttattgtatctccaaaagatacaagagaagttaaatatgattaggagcagggaagaatggaaagattaattcttattttagtttcaattggtttagctatattggataattcaataattccttttttttcaatacatgaaggatatcctagtttattatttacatttgcaattgcttattcattagttaataaaagagaaaagtctgtatttatagggatagtaactggaatattacaggatatattcttttttaatggatttggagtaaattgttttttaaacttactactatgttttcttgcatcagtaattggagaaggaatgataaaaaataaaaaattagttcctgttgtttctatgtttattattacaatattgaaatatatgggtgtgtttgcaatattctgtattttaaatattaaagtagatctatcaaaaggcttatatatggcagtatataatgctgtagtaatgttttttggatataaatatattataaatatttatgatgatgaatatacaaaacaaagatggaggtttaaatgatagttaataaaccagtgaaaaaaaagaaaatctcacgatatactgttttgtgcattattatgggaattatttttggagcaataactcttagacttttatatcttcaagtttttagttatgaagagtacaaggaaaaagctaatacaacatcaacaagatttgtatcagaaagtgcaccaagaggtgaaatatatgattcaaatggagtaacattagctacaaatgtaagaacatattctttaacttatacagaaactgatgttactcaaaagaacttttactcaactatgtcagaattatttaagatattagatgaaagcaatgagaacattcaggatacaatgcttttaaaagttaaagatgatggaacaatgtattttgattacttaagcagtgataaggattcgcaaaattattctgaacttagatttaaaaaggacagaggttttaatgaaccaatacaaaataaattatttcctgaaataactgaattctcagatgagcagaccaataaaataaacgaagaacttttaaagattaccccagaagaatcattttatatgcttgttaagaattataatttaatagaacttattgatccggaatataattctacaaaagagaaaaaagaagcatataaaaatatgactggtgaggaaataactcaaaaaattcttgatgcaggatactctcttaatgatttaagaaaatatatgcttgtaaaagatacaataaaaatacaaagtttaaaaggttataaatcagtaactatagcaagtaacataaaaaaggatacagttcttataataaaacaaaaacttaatgatatgccaggaatagatgtaagttcagttttaataagagactatccatataataatcttgcatcttctgtacttggatatgtatctacaataaatagtgctgaagaagagaaatacagtatgagaggatacgatgtatctacagatttaattggaaaggctggtatagaatcagcatttgaagaacaattaaaagctgttaaaggtggaaaaactgttaaagttaattcttcaggaagagttacagagaaattatttgaactagaatcttacccaggaaataatgttcatcttacaatagatagtaatatgcaatatgttgctgaacaggcgcttgcagatggtattaaagaaattcaacaaaatggtacggatacagatggatacagatttagaaatgcaacaaggggagcgcttgttgcagtagatgttaaaagtggtaaaatcttatctttagtaagttatccagattataatccaaatttatttactataccaggtactttaacatcagaagaaagtaaacagtacttcaatcctgatttagagacttttggtaaagaacttattaacagaatgaatttaaacaaaactgttgatgatttgtttcctaaagatagtaagggagtaagacaggataacaatgacctgtatcctagaccgttttataattatgctacaatgtcattgataccaccaggttctacttttaaacctcttacatctatagctggattagagtcggatgtaataacaccttcgacaactataaatgacactggtaagtttaatatacatccagaggtatttggtaaaggctttgcaccagaatgccttcaatacactaattatggtgcaggacatggaaatcttaatgttgcaggggcacttgaagtttcgtgtaactttttcttctatgaaacagcatacaaattatatatgcttaatggaggaaatttaaatgcattagattcgctagcaaaatatgcttggggatttggattaggtgtagaccctaatggaagtgaaaaagcagctacaggaatagaaataaaggagaactttggtcaaacttataactttacatcttggaaaaaacaagcaataaactatgctaaatttgaattagtagattatttagaaaaaggtgattataaaggaatgggatatgtgtttattccatttgatataagatattcagaagatgataatgaagaagttaaaaatgctaaaaaagcaataaaagataaaatggaagaaacacttgcaaaagtaggaacagatgattttagtaatataaatcagaatgattttactaaagaaattaaaaagtatgtacaaattataatggacaattcagatgtgtataagcagagagtatctgattatgaagcttctgggaagactgttaacttagattcacaagctaatatagttgctgaagttatagctaagtttactttaaatgataagcctgtagaaataacatctccagcacagcttatatatgcatcaatagggcaaggtatgaataactatactcccttacaattagcttcatatatatctacccttgtaaatggaggaacaagatacaaacttcatttagtagataaggtaacagataatgatggaaatgtagtacaggaatttaaacctgaagttttaggtgaaatgcatttagataagaatgatgttgaagcagttaaatacggaatgtctaaagttaatagtgatgatagtggtactgcagcatctaaatggcaaggatttcctatatctactggtggtaagactggtactgcggattttgctgaaaatcaaaaggaaagaggaagagctccatatgcaacatatgtaagttttgcacctcttgatgatccagaaatagctgttgttgctgttgtttttgatggaggtcatggaggttctattgcaggtgctgttagagctgtattcgaggaatattttaaggatagaatattagctggtgatcctaattatgcatcaaaatctgagagttttagaaagtatgttttaggaaatccacttacaaagaataaagagaatagtactgaaaataacagcagtaataatggtacaaataattctcagtctaattcagcaacgggtaatatatcaaatcaaacggtaccggcaactgactaaaatataaaaatgtaaattaatatgattgttaaaatctctgttaggtatataattttactaaaagtataattaacctagcagagtttttttcttattattaagatattaattttaatagagttaaattttttatatgtgtgatataacatagtcctcataaggatttttataagaattatagatatataagaagtttaaagttttttagtattagaattttagaatatgtaaaaaatatttaatgtgcagtttacattgataatgaaaaattaaatgctggattgtagaaaataattatagaagtttatgaagtatatgcaaatattgagattcaatatatgactaaattataattaaaactaagatgatacagagaaaggataaaaaatgaaatacgataaaattacaaaaggaagattcatatcaagaccaaataggtttattgcaaatgttgagatagatggaattaatgaagtgtgccatgttaaaaatacaggtagatgcaaagaattattaataccagggtcaacaaaggtatatgtacaggagagcgataatccaaatagaaagactaaatattcacttatcggtgttttaaaagatgataaaaatataaatatggattcgcaggttacaaataaggtagtacatgaatggattcttaaaggaaatatatttgaaaatgtaaaacttataaaaccagaaaagaaatataaaaattcaagattcgatttttatgttgagacagaaaatgaaaaagcattcattgaagttaaaggggtaacattagaggaaaatggtgtagtaaggtttccagatgcgcctactgaaagaggtgtaaaacatatcaatgaattatgtgaatgtattgatgatggatataaggcatatataatctttgtgattcaaatgaaagatgtattgtattttacaccaaatgatgatacacataaagcatttggtgatgctcttagaatagcacataaaaaaggtgttcaagttcttgcagtaaattgttatgttagtgaggatagtattgacatatgtgactatgttgaagttagattgtaaataaataacatattatagcgcaaaatatgttataatataatatgtatcataaaataaaaagaaataaattgttatttttgaaaataagataaaataatttaaacacatatacaaaaatacggtggataatgatataatttagagaggttaatgttttcagaaaatttaatgaagtatttttagacctgcaaagtagttgggggtaataaatgtataataatgatgggattttaattaaaggaaatagagatggtataaatacaacaattaatatgagcaagttttcttcatttgaagacatgattacgttattaattaaaaagctttcaaagggaaagcagttttatcaaggtactacattgattttaagaatagatttaaaactccttaatgaaaaaaattatgaagaacttaaggaaattttattaagtaagattggtctaaaagatattgtgtttgaagacttagaaaaagaagcagaagacataaatcaaaaggaaaataaggtttttactggtgtatatgaaggaaaaactaaatttataagaaagactgtaagaagcggacaatctgtaaattatagagggaatatagttataataggagatgtcaatagtggtgcagaagtgtatgctactgggaatgtcgttgttcttggaagaatacaaggtaaagtaagtgcaggaactaatggaaataataaagctataatagctgcatttttattacaacctgagctattaaaaatttctaatattatagcaatgtcaccagacgatacagaaaaacctaattatcctgaacttgctaaaattaaagatggtacaataatagttgaaccgtatttacccaataaatatatatattaaaatgtcggagggattaggaaaatgggagtgtctattgtaattacttcaggtaaaggcggagttggtaaaacaactacaacagccaacataggaacagcgttagcatcgcttggcaaaaaggtagttgttattgatggtgatacaggattaagaaatttagatgtattattaggattagaaaatagaatagtttatacaataattgatgttattgaaggtagatgtagattaaagcaaggattaataaaagataaaagatttcaaaatttatgtcttttacctacagctcagacaaaagataaagatgatataagtcctcaggatatgcttagaatagttaacgaactaaaagaagaatttgattatgtattaatcgattctccagcaggaattgaacagggatttgaaaatgcagttataggtgcagatagagctgttgttgttgtgaatccagagataacatctgtaagagatgctgatagagtaataggtaaacttgatgcaaagggattagaagatcatggtgtaataataaacagattaaattatgaaatgactaaaaatggtgatatgcttgacgtatcagatattatagaaaccctttcaattgaattattaggagtagttcctgatgataaaaacataacagtttcaactaacaggggagagcctatagttctagatgaagaagcaattgcgggacatgctttcaaaaatattgcgagaagaataataggcgaagaggttcctcttcttgaattacatacaacagcaaatgaagggtttttcaaatcttttttaaaactgtttaaacgtagttaaaggggaaagggaaatgggtttttttaagagtttaaatagcaaaccgacaccgaagcaagttgctaaagacagattaaagttaattttaatacatgatagaggagaaatagcaccagatattattgaaaaaataagagaagaaattttaggtgttatatcaaagtatatagatatacagattgatgatgttgaaatatcagtaaataagaatgtggaagagggagacaattcttcagcactagttgcaaatattcctataaagaatttaaaaggaagataaatttgctcgcctgagaaagttcaactaaccaaatataaaatttggagtttcacttgctcgctgagaaagttcaactgaccaaatgtaaaatttggagtttcactttttataagatacctacttaattgtgattataaacaaaaagaaaaagaaactgattgaaatggaaaggggatttctgttttatcagtttctttttctttaaaatatactcattttttaagaaatatatgaataattttaaaataataattaagatagaagataagtttttttataattattacaaaattattattatttaattagaagagattcttattatagagaatgaaacaataatagtgtataattaataagaaatatgttatattgagatgtatttcatggaggtgaaatgttgtttaaacagtttaaattagatataaagctaataaaagatattgataaaacacttttattttcaatgattgctttagttttatatggaatactaaatatatatttgtgtacaaaaggcggtaagtatgatggatttgcttttaagcagtttgtttggcttataatatcattagttgtactgtatatatttttatcaattgattatacaataatgatgaattatgtgcccttattttattggggatcagtaatacttttaatagcgacaatgttttttggttcagaaattaatggtgctaaaggatggataaggttaggtccgctttcactacaggcatctgaaattgcaaaaataggaataatacttatgttggcaaagaagttagatgaaatggatggtaagataaatgatgtaaagaatttttttacattggtattttatacagctgtaccagttttatttattataattcaaccagatatgggaatgactatggtttgcttttttatagtacttggaatattttttgtggcaggattagatatgaagattattggaggtggtttagcatctcttgttatagctataatcgtagtaataaattcaagttttattccagcatatcaaaaaagcagatttacagggttcttaaatccagaagcagattatgctggtaatggatatcatttaactcagtctttgataggaataggatctggaggaatacttggaagcagaccatcattaaaagcagatgctgctacaggatatgccgctcagaatgtaccagaagtacatacagatttcatcttttcagcaatagcagagcaattagggcttttaggagcagcttttctattaattctatacggatttttgatttatgagatgatttctatagcacgaacttcaaaagatatttgtggttcagtaatatgtgtaggaatagtatcatatttcctatttgcaatacttcaaaatatcggaatgacaatagggttgttaccaattacgggaataacattaccacttattagttatggtggaagctcacttcttacaactgttatatcagtaggattagtacttaatgtaggaatgagaagaaaaaaaatacatttttaaaatattataaattgatttgtatgctgactttaaattttaaagtcagcttttttaatttgtaaaacttcttctcataaaacttagaagtggaaaatataatttaataatgagaactttaagggaggatactatgggaaattattcatctgcatatgaagaatattataagaatataaataacaaatcgataacgaaagaaagtggtaataggggtcctttcttaaaccgaggagtaaataatactcagagtaataaatttcaatcaagtaatggtgaagaaacttattatttttctaaagactattggataagaagaatagaaagagaacttgctggatcacttgcgttattagcatgttttatgggattaaagtataccaatataaaaaatgtgcaggatttttataagtggtgcaagcagaacgttgtaagtgaatttaattatgatcaatctgttgaagttcttaattcaatggaaataggtacatttaaaactaaagattttaaaataggaacttttcaaattgaagatttaaaatctgaaaatttgaaaacagaaatgaaaaactttaaagaatatataaataagttacaaggagaaaaagtttaaattattgcaattttagaaaaataaactgaagtgacgtatataaatggactagaaaggagtgaatattgtgaaagtattaaaattataactaagcatataaaatcagtttatacgacacaacaagcaatattataggggttagaaatgaaaaaatggattgtgattttattagttgagttcctagcacttatgtggattgcagattttcaagcgtcagttataattagctttttatggataatactacatgaattttcacatattttaacagcaaagagatttggatgtacatttaataaaataaatatcagcatttggggcgtaaaagctgatttaattgattttgatgaattattagaaaaggataagttagtagtttatttggcaggtcctgtttttaatattactatgagtatagtcttattttgcttatatagtgtgtttaaattaaattatttaaaaagcagtataattataaatctttgcttaggtgcatttaacttattacctgcttacccattagacggggcaagaattttagaaatattattatctaagaaatttttgtataagaaatcaaaaaaaattacagaatgtattagtattattatttcaggagtattatttattttatttaatataatgcttttattacataaggtaaacataagcttatttctagcatccatattaatggggtatactacttttttggaaaaggaaaagacaatgtatataattatggatgatatgatcaaaaaggtaagaagactaaaaaagtataattacatggaaaataaatctatttccgtatactataaaaaaggtcttgttaatgttttaacacttgttgataagaataagtttaatagtttttacattcttgacgatgatatgaggcttattacaataatacatgaagatgaacttattatggctttaaaggaatatgggaatattactttagaagattatattaaaataagaaataaccattgattataaaaaatatgattagggtgaatcaatggttattattaataaattgaagtacatattattgtaggttataattaataatatggtaatatttataaaaaatagaaactttaaatttataatgagggatgggataatattatgaaaagaaagaagattgtatcaattttgctgagtttgtgtatatcactatcgttaatgacaagtacggcattcgcagcagaattagacagtaagaattttgaacaagcaatagtaaatgtgaaatcaatagtttcaatttcagatgactataaaaatttttcacactcatcaagagaaattagtaatggaaataatagtgtaactgtatgggatttagaatgggaaacagatgatgaaaagggaggatatatttcagctaaagttgattcatatggaaatttatgtgcttataataattataataataaaactgatacatcaggattagctaaagtaagcaaagaaaaagctgaaagtacagcaaaagaatttttaggaaaagctatgccagagttttcaaaggatatgaagcttgtaaatagtaatatttatagtgatgaatattattttgtatatcaacagtatgtaaatgatattccagtaaattttattaaagttaatgttggagtaaataaatttacaggagaaatatcttcatattcaggtcttaaaccaggaactaaaaaacttgactatcctcaggttgataatgttataggtattgaaaatgcagaaaaaatatatatagataagattcaaaatgatttatgttattattcaacgtatgattacaaagaaaaaaagaataatactgttgcattgtattcatttgatagcaataaagcagttgatgcaaagagtggtgaaattgtaagtttagataactatagatttaatgaatatttagataagaattctggaagtaactcagtaacggaagctgattcagcaggtttgagtgaagttgaaaaagatgaagttaataaggtttcaggattaatttcaaaggaaaaggcacaagagataataaatgaaaatagtgatttattatcttctatgaaaatagaagatatagtacttagaaaaacatacagaggggattcttacttatggcaactaagctttgatggaggaaatgcagaaataaatgcttccacaggagaaattattggtttttatatttataaaccttctgaatcaaaagaaaataaagttactaaggaagaggctaaaaataaggcagaagcattattaaatagacttgcaaaagataagttcaatcaaacaaaactaatcgatgattatgatacatcagaatcatctgaatataattttgattatataagagaaatagatggaaaaggatatatgagtaatgtattgagtgtttcagtagacaaaaacacaggtaatataataagttatagcaatacatgggataataatataagccttccagacataagtcaggcaatttctaaaactgatgcatttaataaatataatgaaccagaaaatttcggtttacaatatgttcttaatgaaaataacactgtaggattagtttataacttctcaggtgaagatatggtatattatatcgattctgtatctggcaaaaagattgatagatggggaaatgaatataaatcaaataaagttccagagtacagcgatattcaagggcattggtgtgaaaaaaccgtaaaagaacttttggatagtggatattatatcccaggagataaatttaatccagacacaaatataagtcagattaacttttttagatatatgttatctttaaatgcttctgattattctgatgatgagttatataatatacttattgatagaggaataattaaagaagaagaaaaaaacactttaggggatgtaactaataaagatgctgcaaaatttataataaggtatcttgggtatgaaaaattggctactaattctaagatttttaacaatcagtttaaagattcaattgatgacgagtatttaggatatgcaaatatatgttatggattagacattattaagggtgactcaaaaggaaactttaatggtgataaaaatatgactaatgcagaagctgcagtatatatttataatttagtttctcagaataataaagtatatctatagagcataagtttttaagttaaacaattatgggaataataagaatattcccaatgaagattaattgtgttagaatagggatatcaaaatagaaggagtatagaagctatacttcttcttatttatgtatgaataacgaaaaatacagcttttgattgctagaagttttaaattgattctacagattttacaaagcaccatagtgttttaaggaggaaagatattaatgaacagagtttcagatgatattttatttaaggttgaaaagccggcaagatacataggcggagaattaaatgaaattattaaagatcccaaagaagttgatataagatttgccttttgttttcctgacgtttatgaagttggtatgtctcatttaggaagcagaattttatatcatacaataaatttaagagaagatacatattgtgaaagaacatttgcaccatggcctgacatggaagagttaatgagagaaaatgatatcccattatttactcttgaaactaaagatgctttaaatgattttgatatattaggatttacacttcaatatgaaatgagttatacaaatgtattaaatatgcttgatatgtgtaatattccaataagagcatcagaaagaagcgaaaatgaccctatagttatggctggaggtccttgtgcttataatcctgaacctttatatgatattgttgatttcttcgaaattggtgaaggcgaagaaatgatgaatgatgttttagatgtttataaaaaatataaaggtaaaggaaagaaaaaagagttcttaagagaaattgcaaagatcgaaggtatatacgttccttcattatatgatgttgtttataatgaagatggaacaataaaatcttttgaacctaagtttgaagatgttccaaagacagttaaaaagagaataataaataattatactaaagttcaatttcctacagatataatagttccatatacagaaatagttcatgatagagtagtattagaattattcagaggatgtacaaacggatgtagattctgtcaagcaggaatgatttatagaccagtaagagaaaaaacaaaagaagatttattagatcttacaagggagttaattaaaaacacgggttatgaagaagtatcactttcatcattaagtacatgtgactattcggatataaaaggattagtagatgatttaatgaatgagcatgaagaaaaaagagttggtgttgcccttccatcaataagagtagatgcattttcagtagatattttaaagagcattcaaaaggtaagaaagactggtttaacttttgctcctgaagctggttctcaaagaatgagagatattataaataaaggacttacagaagaaaaaatattagatgcagctacaagtgcatttgaatctggatggaagactcttaagctttactttatggtaggtcttccttatgaagaattagatgactgtagaggtattggtgaacttgcagaaaaaatagtttatagatataagactgctaaaaaggaaaataacaataagggattaagacttacagtaagtacatcaatattagttccaaagccatttacaccattccaatgggctcctatggctagaattgaagatgtaaatcaaaaaattaatgctgttaaggattctataaagagtaagtgcatagtttataactatcatgaacaaaaaacatcagttatggagtcagtatttgcaagaggcgatagaagattgtgtgacgttttaataaaggcatttgaaaaaggtgctcgatttgatggatggaatcaatatttcaaatatgatatatggcaggaatcattaaaagaatgtggtttaaatgaagatttctatgcatttagagaaagatcatatgatgaaattcttccttgggatttcattgatattggagttaatagaaaatatcttgaaagagaaaatgaaaaagctaaaaaagcagaattaactcaaaactgtagaaaaggttgtacaggatgtggagttaacgtaaactttaaggaaggagagtgctttgaaggtgcgatacttagttaaatttacaaaagaagaaaacattaaatttatatcccacttagatgtactaaaaacaattcaaaaaaatataagaagagcggagctaccaatagaatattcacaaggatttaatcctcatatgactacatctattgcacagccattatctgttggagtatattcaagtggtgaatatcttgatatggttttagttgatgaaatgaatgaagatgaaattattgcaagattaaatgctacagcgccaggcggaattaagtacataagtgctcttgctattccttataaagaaggagaaaaaaaagtgccacaagctatggctatgattgatggagcaagatacacaataaaagttaagtattctgatgtttcaaacttagaagaagaaataaaaaaaatactacaaaaagatgaatggaacattataaagaaaactaaaaagggtgaaaaagaaacaaatattaaagcaatgatcaaagaattcaaattttgggttaaagataatgctttagttatgaatacattaataagcactggaagtagagaacatttaagtgcagatttattagttaaatatattcaagaaaatacaagcaatgctattacagattcatttgttgatgttaagagagaagaaatgtatttttataaaaatgacaagttagtacctctttacaaatgtgtgtaaccataaggatttaaatattatcaattttatatggttgtttgtttaaatacgggttttattgttaaaaatatataagagagattaatggttgttgcaatagttataatttgcagcaaccaactttttaggatgtgttagtgtgaaggaaatttttatagagagaagagaaaatatcttaagaattgcagtaaaggttaataatgaacttgttgagagtattgttgaggagcagaatgatgagcctataataggcgaaatttataaagctagagtaaaaaatatacttcctgcaattaattcaatatttatagatatgggattatcaaaagaaggatatatgtactatggtaatgaccttaaagatgcaaatataaaaaaaggtgatgacatacttgtcgaagttgtaaaagaacctataaacgataaaggtgcaaaacttagtcataaagtttcgattccaggaaagtatgttgttttgaattgttataatcaaggaatcagtttttctaaaagaataactgatgaaatcagaaaaaaagaaattttagataatataaaacctttagatgatgtgagtatcacaataagaacagaaggaataaatacagacataaatattttacaaaaggaaatagacaaactctatggagaatttgaaaatattaaaagaaagatgaagtattctaatgaattaaaaaagctttatggtgaagatcctactttaaatagacttttgagaaattcatataatgatgaaaatactaaaatatatgtagataatgactctgattttgaaaagatacttaagtttattggcgaagaaaaagaacttcaagttgaaaagtataacggatatagaaatctttttgactgctatggaatagaaaaagaattaataaaattaagacataataaagttaatcttcattgtggtggatatatagttatagataaaacagaagctatgtatgtaattgatgttaatagtggtaaaaatataaaggaaagaaactttaataagactattcttgaaactaatttagaagctgcaaaagaaataggaaagcagataagacttagaaatttaagtggaattatagttgttgactttatagatatgagagatagaaagcaaaaagaaatcgttatgtctgaactttacagtagtttaaaagaagataaagggaatgtgaaaatcttcccatttacagagcttgatcttgttcaaattgcaagacgtaggcaggggaaaagcatctatgaatatatggaagaagaatgtttaagatgtaaaggtagaggaataattttaaaattatcttatattgaaggtcttattagaaacgagattataagaatgaaagaagaaaattctatagacagttttaagatagaaatagatagtgtttataaagatagaataaaggatgatatttttagttttataaaagaaattgatggattagataatgagatttatcttgattatgttgatggaattgaaggatacagaatagaacctttattgtttcagactcaaaaagagaatttgaaaaaattaaaaattacagaaatagaaaaagcttaatttggttaaactgaaaaatctctttacaaaagctgaaaattatgatattatggcttttgtagaccgcacacgtaaggtttttagtaaaacaaagtcaaatctttgtaccaaaagtggcgagaccgttatgaggaggtgttttttaatgtacgcagtattaaaaacaggtggaaaacaatacagagttcaagaaggagacgtaatatacgttgaaaaattagacgctgaagttgattctacagttgaattagaagaagtattagcagtaggaactgatgcaggtatcaaagttggtgctccagttgttgcaggtgctaaagttgtagctaaggttgcagctcaaggtaaggctaagaaggttatagttttcaagtataaagctaagaaagactatagaagaaagaatggacacagacaaccttacactaagttagttatcgaaaagatagaagcttaatattatggttgaagtaaaagttagagaaaagagtaacaaaatcattggtttcgtaattaatggtcacgcattatctgatgatagagatttttcaagtgattctgctcttgtaggagaagcatttgacttaatatgtaacagtgttgcagttttatcacagagtgtaatcattggtattgatgaggtgttaaaactaaattgtacatacgaaatgaaagatggatacttaaatcttgatcttcaggattttacttctgaagaaatagaaaaaactcaagttttactaaggacttttgagaagagcctagaaagtgtcattttaggtttcgatgcattagttggaaaaaagaaacgtatggaatatataactttaataaaagaggaggtgtagtcacatgctaattatgaaccttcaattattcgctcataaaaaaggggtaggtagtactaagaacggaagagactctgaatctaagagattaggagttaaatctgctgacggacaatttgttcttgctggaaacatccttgtaagacaaagaggtactaagattcatccaggtgaaaatgttggaaaaggtaaagacgatactttatttgctaagatcgatggagttgttagattcgaaagacttggtagagataagaagaaagcaagtgtttacccagtaaacgttgaagcaatagctgaataatttttttgaaataaagcactcttagcaaagagtgcttttttaaatgtagatttaatgcacaatgcacagttcataagtttttcaaattcttatgtatgatgttttttgtgagttgtgcattgtgccttataattaagaaaatatggatgctattttatcaagcatctaaagagttagataaggcattaaaagaaatgtgatataatgtgaatacaaatttataatttgttaagtataagaatagtaataaaattcttagtaaacattaagattagaattttatagtgttagttaggagatgagtatatatgtttatagataaagccaaggtttttattaaatcaggaaatggtggagatggtgccattacattcagaagagaaaagtacgtaccattaggcggaccagatggtggagatggaggaaaaggcggaagcattattttcaaagttgatacagggattactacattattagatttcaaatacaaaaagaaatttatagctgaatgtggtggtaatggaagcggatcaaaatgttatggtaaagatggagcggatcttataattaatgtaccaatgggaacaattataagagaagctgaaagtaataaaataatagcggatatgtctcataaagatgaagagttagtagtattaaaaggtggtaaaggtggtaaaggaaatactaaatttgctactgcaacaaagcaggcaccacattatgctgaaccaggtatgccaggagctgaattaaatataactcttgaattaaaattacttgcggacgtaggattattaggtttccctaatgtaggtaaatcaacattactttctatgactacaaaagcaaaaccaaagatagcaaactatcattttacaacaataaagccaaacttaggtgttgttgctgttgatggaatagaaccatttgttatggctgatattccaggaataattgaaggtgcagctgaaggtgtaggacttgggattcaattcttaagacatatcgaaagaacaagattattaatacatgttgttgatatatcaggtgttgaaggaagagaaccttttgaagatttcgttaagattaatgaagagttaaaaaaatactcagttaaactttgggatagacctcaaatagttgtagctaataagagtgatatgctttatgatgaaagcatatatgaagacttcaagaaaaaagttgaagaattaggatatactaaagtattcaaaatgtcagcagctacaaatgatggagtagatgctgtaatgaaagaagcagcaagaatgcttaaggaaattccaataactgaactagaaatagctgaagatgaaagatacatcccagaagatagaaagttcacttatgaaataagtgttgaagataatgaagaaggtacaaaaacatatgttgttgaaggtacttttgttgatagattattgcatgctgtcaatgtaaatgatgctgactcgttaagatatttccataaggttcttagaaataagggagtatttgatgaagttagagaaatgggaatcaaagacggagactttatgagattaaatgactttgaatttgaatacatcctttaatcaattaacagttaacaagtaacagttaacaattgtggatgaaattcttatagaatttctaaaaaatataactgttaactgacaactgttaattgttaactgaaaaccccccagggataaataatgcaaaaaacaaacagcaattttaggaggaaaataaaatgataacaacaaaacaaagagcatatttaagaagtttaggaagcacaatgtcacctatatttcaaattggaaaaggtggaattgaagaaaactttttaattcaagtaaagcaggctttagaagctagagagttaataaaaataaaagttttagaaaatagtggattagatactagagaagcttcagacatgatttgcaaagctgttggatgtgaaggcattcaagcaataggaaataagattgttctatataagcaatcaagtaacttaaaaaagagaaaaattgaattacctactaagtaagattacttagtttaaaaatacagcattttttatgctgtatttttttgtggaattttattaacatcataaatattttaataagaaatgatataataatatagttagtataaaatactttgacaagagaatatttaaaataactatgataagcataggaggaagctaaatgaagcgatatggtataataggaggaacatttgatcctattcataatgcacatttatatatagcgtatgaagcaaagaaacagctggatttggataatgtagtatttatgccagcaggaatacaaccatttaaaaaagaaaataaggttactgattcagaacttagatataacatggttaagttggctatagagccatacaaagaattttcaatttcagattatgaaattgaaaaagaagggcttagttttacttatgaaacattagagtattttaaggaaaattacaataacgaaaaagtagaccttttctttattacaggagcagattgcttaatgagcatagataaatggaagaatgtatccaagatattttcactttgcacttttgttgtgttttcaagaggtggatttaattcagaagatcttagtgaaaagaagaaagaagttgaagaaaaatatagctgtaaaattgtcattttagaattaaaagaattagaaatatcatcaacagatattagagaaagagttaaaaatggaaggaaaatagatttttttgtgccggaaaaagttaataaatttatattagaaaataatttatataaagaatagataattgattataggaggggttaaattgctatcaatagaagaaattagagagtatttaaagtcgaatttaaaagaaagtagatataatcatactcttggtgtatgtgaaacatctgtaaaacttgcagaattaaatggaatatctatagaaaaagcagaaattgctgctcttgctcatgatgttgctaaaaacttagataaagaggaaatgttaaaaataataaacgaaaataatatagaactttctaatgttgaaaaagaaaatatgaatttatggcatagtataataggaccaatagtagcacaagaaaaattaggaataactgatgaagatatattaaatgccgtgagatggcatactactggaaaggaaaatatgtctgttcttgtaaaaataatttacatagcggatatgatagaaccaggaagaagctttcctggagtagaagagataagaaaagaaacttttgaaaatcttgataaaggagtttatttaggacttacacatagtattcagtttcttttgagcaagaatttattgatagatgaaaatacaatgaaggcaagaaattattttttgtttaaataatatttttatctggatatagtgtatccattgtcaccggataattgtcaatttaaaacatattaataaaatattaaataaaaataagatttacttaaaagattttaaagaatctcttatggtcatatggttagagggtatttatgatagaatatatatgcagttaacatagttattgaactattagtaaaatagtagataagtcatattattatgtaatgtaaaatatttaatactgtaattaaaaataagttttaagatgaattacagtaaagaggtgaaaaaatggggagaaaagataagaaaaagaaacggtttaacaaaggtaatgatggtacaaataaatttgaaaaaataatacttggagttatatcgatttttttaacttttacagtattttcgataatatcaggttttatagcacttatggaagtgggaagtcaatccatgcctaaggcatcaaacccatctggcaataaaccagtaaatattctactcttaggtatggatattggagatcctaaccaagaggataataaggatattaagcgtacagatacaataatggtggttaattataatccagaaacggataaaataacaacagtatcagtaccaagggatactttaatacagaataatggtaacagtgtaaagattaattctgcatttgccattggaggatattccagaataaagacagaggtagagggtcttcttaatgtaaatataaattatatagttaaagtagattatgatgcatttgtggatataatagatgccataggcggagttaaaatgaaaattgaaagaaatatgatttatgatgatgaaggacaaaatcttcatataaactttaaggctggagaaactgtgaagcttgatggacagaaagcacaagaatttttcagatggagaaaaaataatgatggaagtggctttgcaaatggtgatttagatagaatacagaatcagcaaaaatttattgcaaaagtaatagataaatgcacaaatcctctcattgtttttagaatacctaagataatgtcagcaataggaaataatgtagaaactaatatgtctccattttcaataataaaatatggattaaagtttatgggtgtaagtaataatgatatatcaatgcttacagctgcaggaactccaaaaacaataaatggacagtcgtttttagtatttgataaaaattcaaataaggatataatttctcagttagcttcatcagaagtttcatcacaatcagaaaatggtatatcaagagagaatataaaaataaagatattaaatgcaacaaaaatcaacggattagcatcagagttgaaaattaatatgaataatataggatatacaaaaattgatactggaaatacagagctttctgataagacagtaatattaagtaataataaaaacatgctaaaaacaatatcaaaggatttagatattaagaatagtggaaaaaaggatgataaagcagaatacaaagattatgatgttattataattcttggcaaggacttcaaaaagtttggagagtaacattatggataaggagataaaataatatgagtatcttagaaaaaaaggtgactggaatagaagagggaactaaaataagagaatatttaaagatggaaatgggattatctacaagattaatcagaagtgcatccattgataaaagaatatttgtaaatgacattccagtaaaaatgaatcgtgttatcaatgaaggtgaagtaataaaaatagatttagcaaaagatgaaagtcaagatattgcaccagaaaagatggatattgaaataatatatgaagatgaagatatattagtagtgaataagaaaccatttatggtagttcatcctacaaagagttatcaaagtggaacacttgcaaatggtgtaataaattattttatggaaagtggtcaaaactgtattgtaagacttgtctcaagattggatatgaatacatctggacttataataattgctaaaaatcaattttctcatggaatgctttcgaaggaaatgactgaaaataaagttactaagagatatcttgcagttgttcatgggatattagaaaatgaagaaggaactattgatcgtccaatatatagaccagaaggaattgattttggaataatgagaatagttgatgaaagaggccaaagaagtataactcattataaagtaatagaaaagtatgaaaatgcaagtcttgttgaatgtacacttgaaacaggaagaacccatcagataagagtacatttaagcagtataggacaccctatatacggtgattctctatatggtagtggagatgaagagcaggatttaataagcagacaggcgcttcatgcatattcattagattttagatcaccaagaactggtgaaatcctttctttaaaatctaatcttccagaagacattaaaactttaatagagaaaattaaaaagtagattaaggtatttaattcaaataattattaaaaaaatatgtaaactaaaaggtctaaaatctgttaattgagattttagaccttttagtttaaatatatttgaatatttaatgcttgccattaattgaaagtttcttttttataaatatacctagtccaacaataatagcaattccagcaatgctaactgcaatatagattggaatcttaggattatttgaaaatgcttcagcagaaagtggtgattcatatgttcttgaaacaccagaagctaaatcaactgtttctaattttttatcattaacataaatagttcctgttaaaatattttcatctttattgaaagattttttactcaaatcttcgtcatttacttttatatcaaaagataaagttgattcatcaccttttaaaacaggatattctaatgttttattgataagtaaaggaactgtaagatttttagtaacatcatattgtgcaacttcttgacctttgtcataaagcttaacaaaagaataattatcgaaaccataattaaatactgactgcatatcgaagaagttttgattcttatccatagcatttagaaatgatgcaataagaatatgtccatctttttcagcagaagatacatatgtatgattagcttttgttgtatatccatttttaccacaaagagcatattgataataatattttgaatttttattaatcatataatttttattattaattattatagttctttctggattattaatcattgttatagtcgcatatggtgtttgtgcaatatctaaaaaatcctgatttttaattgcttctcttagaaagagtgctaaatcatgaggcgttgtaagatgttctggatctggaagaccacttggatttctaaagcttgttgcagtagcgccaagttcctttgccttttcattcataagctgtgcaaagctgtcaatacttccacttacatgataagctaattcattagcacaatcattaccagactccataagtagtcctaaaagaaggtcatgaacggtaacaacatcaccttttaaaagaccgattgctgtaccatcaacagaagtgaaattctcttgaatagtaacttcatctgttaatttgcatttgtctaaaacaacaagtgcagtcataactttagttgttgaagcaggttcaaaggtgcagtcttcatttttaccataaagaattgtgccgctcgatgcatctattaatgcgcacccttgagcattaatttctggttttgcagtttctgcatgtactgttaaaggtatacacagaaaaagtagcagcatactcaaaaatttaaaatatcttttcataaatatctccatactatttctattttagttatcactataaagtatattttaccaaaaaaataattattattccacttaaagttaaaatatatacatttaatgtgtaaaatgtatggattttggcaattattaaaataatatgattatttataggaaaggatgaagttatgaaagataactttcttaagtataagaagataggattaatgagtattttggctattgtagtaattgtaagcgtgattttttacaatgctaaaggattcaaacaactcaataaaaataatactgaaagtatttttgtagatgatgataatcttgtatttgaaaatggtaaagaagataagttaccttcacaggattctgtaaatatgagtaagcaaatggaaagtaaattagaagataaaacaatagtcgttgagataaaggggcaggtaaaaaaaccggatgtttacatcattgatgaaaattcaataataaatgatttaatagatttagctggtggagttactgaaaatgcagatttaagcaatataaatagggctaaaaaacttcaaaatcatgaaatgatttatattgcagataagaatgatatcaataatgattatactcaagctactaatatggaaaatggttcaatggataatgaaattcttgtagatattaatactgcaactacagataaattgaaaacactaaatggaattggtgattcaaaggctaagagtataattgaatatagagagcaaaatggaggctttaagagtatagaagaaataaaaaatgtaacgggaattggagataagatgtttgaaaaaataaaggaaagtatcaccgtttaattttggttatattatcatgttatgaaaatttacattaagatgttataatataaaagtattcatattacagaagtagaaaattataatcaaatatgaataatgaaattaaattgtgagataaaaatgggataaaatcttggaattgcatggtttatgaaaagaatatataatagaaatgcttagatttaaaagttatttataataataaattagatcaatcttaaggattattttgaagaattaagatgcttaacaaataatattttgacacatagttgtaatatggaagtgatatcattaaaatgctgatattgttattactacatgtggacatattacttaaatagtaaaattgaaagattttaaattaaaatttattcttaaaatttatgattatttctatttatatattaagtcatataaacaaggataaaataaaaaacatgaaagaacctatacctgagggggaaaaactaatgtctaaaaagatagtaagtatatttatgagtttaatagtagcagcatcacttgcaggctgcggaaaaagtacagatgaaaacagtagcaatgcaaaaacagctaatcctacagaaagtgcaaacaacactgtgaccaatgaacaagcagaaggtaaatgggcacaaaattatactttagatgaaactaaaaagttatatgaagaaaagttaagtaaaatgaaagaaataactgaagaattaggtgtaaagtatagtagtgatgaagtaataaaaaaggaagatgataaaacaataacggataaatcaatatactttgataatgaaaatccagaaaataataaaatagaaagtatgtattatggattaaagatatatggtgaaaatcttgaagaaggtgtaataagcttaaaacttacattaaagtttgatggcgaaaatgcagtaaagaataatgacttagatttaggaaaaacatcatttgcaaagtacatagcggcctttacaggagaagctgatagagattattctgacataaataaagaaatcttagaaaaacttgcaagtggagatactgaagtaaggataaataacacaattgatgggctaaatgaagaaatattagcctcaaaagattgtattttttataaattatctacaaaaaaatataaattcgcagatgcagaaatgagtatggaatagaccgtaagggggaaattttcttggaaaaagataatgtaaaagaaaatgaaacagaagttaatacagatgaaaaagaagaaaacagtgtagagctttcaaaagaacatgaagaaaatacaaataatgaacttcaagatttaattgaagatcatgaagaagttgattctaaagaaaataataagccatcatttggcaaggagatatttgcaaatcttttagatcagtttgtgattcttgcaggttcatcagttatattattaatagcagacgtagttatgcgtatgtttggatatcagtttgtaagagaaactggaatattagtagcagtagttatgtgtgtatactttgttataaactgtttctatgtacagctaatggaaagaacaaaattaaaaaatactattgcaaagaagatattaaatctataaaattatatacaataagattatttagcagattgggtttacgtaaaattagttttgtgtaaataccaatctgttgttctgattatggatagttaaaaataaaaaactatagatgaaaaaataatgattataggagtaaataatgagaagaggaagcgacttacaagttaaaatagaaaaattacaatttccatcaacagggattggtcatgcagaagataaaataatatatgttaaaaatgcatttccaggtcagactgtaacaggaagagtaaagagaaaaagagaagaatatgctgacgtaaagttattacaagttgatgaaagagcagattatgaaatacaagcaccatgtcctcattttggagtatgtggaggatgttcatcacaaagtcttccatatgaaaaacagttggaatttttaagtgaagaagttaaagcattatttgacgaagctggtgtaccaactggtgagtatcttggaatacaaggaagcccaacacagtttgaatacagaaataagatggaattcacatttggagatgaagctaagggagctccactaggtgtgggtatgcatatgataggtaaatcttttgggatagtaacagttgatcaatgtatgctgattgatgaagactacagaaaagtaataagattaacagtagattatttcagagaacaaaatttaccttattacagaataatgaaagcagaaggatacttaagacacttagtaataagaaaagctaagaatactggtgagcttttagttaacttagtaacaacaactcaaatagactttgatttaagcgattatgtgaagttactaagaaatgaaagttatgatggaagattagtatctataatacatacagaaaatgattcaaaatctgatgcagttatacctgaaaaggttaatgtactttatggtaaagactatataagagaagaattattaggattagaatttaacatatcaccattttcattcttccaaactaatacaaagggagcagaacagctttattcaatggtacgtgatttcatgggagatagtgaaaataaggttgtatttgacctttattgtggaacaggaacaataggtcagatagtagctccaaaagctaagaaagttgtaggaatagaacttatagaagaagctgttgaagcagcaaaagaaaatgctaagcttaatggattagaaaactgtgaattcttagcgggagatgttgctgaaataataaagaatgtaaaggataagccggacataataatcttagatccaccgagaagtggggtgcatccaaaggctcttgattacgtaatcaagttcaatgcaccagaaattatttatgtttcttgtaaccctaagacattagtaactgatttagaagttcttactcaaaaggggtataaagtagttcagactaaggttaaggatatgttccctaatacgcctcatgctgagacagttgttaaacttacgaagaccaaagggatgaagtaagtctaacaaatgtctgtgcaagggatgcccaagaagctgagagaagcaaactcagatttactgtagaaactttacaaggataggattaaggaaaacttagtcctattttttatggatttgttcaacaaatttttttactgtaatagaaaataaaagatatatttatagtaataaaaaataagaagcataaatataccaaaatataacaatatacatttatttcagtgaaaaaagttacaaataaaattacataaaaaacaaaaaaatacataataatacaaatataaatgttataattttttcataacgtaaaaagagaggttaatattatgaatgatttttgtgaaaaatgtgaattaaatgaatctataaaagaggaaaagaacttattaaataatgctatagttgaaaaaaataataatttattggatgagaacattattaaaataagtcagtatatcgataaaatgatttatgattgtataaaatgtaagataagattagtagatattaataatgaaaaagtaagtttagacagtatatttggaatacattcaacattttattattatggagagcaacatttatttataaatatgtacaattatataaagaaaggcattgaaaataatgaaattatatatctttttgtagaagataatatttataataagttattaaaagttttaaatgaaaacaatgtttgtgtagatgatatacaatttagaaatgttaagccacttattcaaggtaatagagatggtggattaaaatcattaaaaaatgaaatttacaagatttcattagaagatgaagttacaaaatataatggaatcagatggataggacaaccgtcatatgcgataaaattaaattcacaagatgctttcttaaattttgaaaaaaatttagatatggcattaaaagatactaatgcatcattactttgcatatatgatgtgaatgattatatggatggtggaaatattattaataagaaagttatagaagaatcacttgaaacacattcttatattttaaaagatgattatttacaagcattagcttaaatccatacgtagacgaattatacagctattaaaatttttaaaataagagtttaggaatatagattttctatactctttatttatgtctaggaaattatataatttttgtacggttaaagtgagataaaatattaggagaaaatacatgattagaaagaaattaataactttgattacaagtatatgcatgcttggacttttggctggatgtaataatagggtagaatattcaaaaactagttcgagtgataatacttcagtaatagataatcaagagaataaaatgacgcagttgaaagatttaagtgaaaatgaaaaaattgagataggaagagatttgtatgataaatatatcaatgaaaacagaactgattggaaaatggttaaatctcaaaatttaaataggcaaccagtagtttgtcttacagattatagaattaatgatgttagttttgtaaaagaggaatccgataaatttactgtagatatttcctatgatattcaatatactgatgaaagtaacttttggattgctggtaatggagaacttactgataataattgggtaattaataaatgtagttttgtggatattcagaagattggggataaatatttcattgttaatttatatacagggtaacaattaaatatggatattaaaaatcatcttaattattacaaatattacaaaaatattatgattatattaccaatatagagagtgtgtttataatagcgtataattgaaaatacgtaaaagaaatatgctatattgggggtaagatattgtttagacaatttaaattagatagaagaatatttaaggatatagataaaacaatattattttcaatgatatcaatagtgttatatggaatatttaacatatacttatgcactaaaggtggagttaatgctggatgtgcaacaaagcagtttgtatggcttctgatatcattagttgtattatatattttcttggctgtagattattctgtaataatgaattatgtaccattgttttattggggagccgtattgttgctaataggaacaacattttttggatcagttgtaaatggtgcaaggggatggattagatttggacctgtttcattacaagcatcagaagttgcaaagataggtataatacttatgcttgggaaaaagcttgatgaaatggatggaaagataaacgatacaaaaaacttttttattttagtattttattgtgcagtgccagtaatctttatattgaagcaacctgatatgggaatgacaatggtttgtttctttatagtacttggaatattttatgtatctggattagatttaaagataattggaggcggattagtttctcttgttattggaattatagtagtatggaattctggttttattgagcaatatcagaaaaataggcttatagcttttgttaatcctacagcttatgaaacagacactggttatcatttaattcaatcacttacaggaataggatcagggggattgtttggaagtaggccttcaataacaagtgaagtagctatgggatatgctgcacagaatgttccagaagtacatacagattttatatttgcagcaatagcagaacaatggggatttattggagctatgtttttgcttgttttatatgggtttatgctatataaaatgatagctatagcaaggacagctaaggatatattcggttcagtaatatgtgtagggattatatcatatttcttgtttgcaataatacagaatataggtatgacaattagtctgcttccgataacaggtattacattaccacttgtaagttatgggggtagttcactccttacaactattttatcaataggattagtacttaatgtaggtatgagaagaaagaaaatacatttctaaattaaataaaaaggtactgttaaataaacatataaaattatttaacagtacatttttttatgtttaaaattagtaaatactcagatactttataacaattagaaagcatacagacaaaaaatctatagttaaagtaacataataaattcttatgaatattatatattgtgaatattattatgaagttaggataaggaattagaataatgaagataaaaatattaaaaaataaggatttagataaattagagaatgatgtcaatgaatttatacaagataaatgtgtaatagatataaagtatgaatcaactcagtatagaacttgtaaatatattgaaaatattttaatagtcattattttatatgattcatatggtaactgtggatatttaaatacaaaatccttaatggattttaaaaaagtataatgtaaagttaagaaaaatcattagggggacaaaagatgaaagtagttattcttgctggaggcaaaggcattagaatgagtcagttaactgttaatactcctaagcctctatgtgaagttggaggaatgcctattttgtggcatataatgaagatttataatcagtatggattagatgattttatgtttcttttaggatataaaggagaaaaaataaaagagtactttgttgattatagttggaagcaaagcagttttcttttagatatggaaagttcaaagattgatatttattcaaagccagaaccatggaagataagttttatagatacaggcgttgaaacaatgacaggtgggagaataaaaaaggctgaaaagtatattggaaatgaaacatttatgttaacttatggtgatggattggcagatataaatataagtgaacttttagaatttcataaaaaacaaggaaagatagcaacagttacaggcatatacaaaaagagtcaatatggtattttaactgtagataatggattagctaaatcctttgaagagaaaaagaacactgaagaaataataaatggtggattttttgtttttgaacctgaaatatttaattatttagatgatgattcagggtgcgttttagaacaaaatcctttaaagaaattagtagaagataatgagctatcagtatatattcatgatggcttttggactgctatggatactttaaatgatattaataatgtaaataaactttggaatgaaggaaaggcagtgtggaaaatatggtagataaattttggaataataaaaatgtttttgtaacaggtgggactggatttttaggaagttatttagttaaaaaacttgttaactctggagctaatgtaacagttttagttagagattctataccaaaatcaaatatgtatattggtgaagaatataaaagtattaatgtagttagtggtaaattagaagactacgatatttttgagagaatattaggtgaatatgaaatagatactatatttcatttagcagctcaggctattgttggtgttgctaataaaaatccattaggaacatttggctctaatatacaaggaacatggaatgtactagaagcagctagaagaagtcctttggtaaagcagattatagtggcatctagtgataaggcttatggagatcaggaaaagctaccatatgatgaaaatatgcctcttcagggaaaacatccttatgatgtttcaaaaagctgcactgatttaatcgcacaaacttattatgaaacttataaactaccagtttgcattactagatgtggaaatctttatggtggtggtgatttgaatttcaatagaataataccacagactattcagcttgttttaaatggagaagctccagtaataagaagtgatggaagttttattagagattatttttatgtagaagatgctgtagatgcatatattgctttagcagaaaaggttcaagaatataatcttggaggacaagcatttaattttagtaatgaaatacagcttacagttttagagttagttgataagattttaaatattatgggaagtgaattaaaatcagtaatattaaatcaaggcagtaatgaaataaagcatcagtatttatctgcaaaaaaagcaagagatatattaggatggtctcctaaatatacaatcgatgaaggattaagaaaaactgtagaatggtataagaatttttttgaaaaaggagatacaggtaatgcaaagtagtgttttctgtactgttttatctagcaagcgattgattcaaggaattgcatgtattttttctttatatgataatacagatgattttaaattatatattctttgtgttgatgaaaaatgttatgattttatgaaaaaaattagttttgataaagttattttagtaaatattaatgaaataaacagagaagatttcgaaaaactaaaaaatactagaaaattaaatcaatactgttggacactaaagccaggctttattaaatatgttatgaattcaaaccatgatattgaaagagtaacttatatagattcagatttatttttcttgcataatcctaatatgatatttgagaatcaaccagatgtatctgtgttactttcagatggaaagatatttctacccatgtattctaaagagtttattcatgatatccaagataagactggaaattataactcgggatttataagttttaaaaatgatgtaaatgcatttaaatgtgtagaatggtgggacaaaatgtgtattgaaagttgtactgcaactcccgaggataataaatttggtgatcaaaaatatcttgatgatatgccacaaattttcagtaatataggggaaataacaactcctggagtaaacattggacattggaattatccaagatatagatttacaattgcaggtgataatatattggtaaataattatgaattgatatgttatcatttcagtggatttagaatagtaagcaaatatgatataaggcagattcatgagcaggatagaataaaccagccatttatatatgatgtatataaaaagatactaagagatatcattgatgaagttgaaaaaattgatcctgattttaaagaatatatgattacaaatgaaattaacagtaattaaatatttataaggagagagtaaatgaaagcgagtattattatcccatcatataattctaaagaacgattgtattataatttgttgtctttaaataatcaggattgtgactttgaaattttcgaggttatcgtagtagataatggatctaatgatgatactttacaaatgttaaaaaagtttaaggcaaagtataatttaaaatttaagaggattgaaaaaaacagtggtattgcacatggtagaaatgaagcaataaaaatggcagaaggagatatattaatatttcatgatagtgatatgatagctcctaaggattttgtaactaaacatttaaatgatcataaagaacaaaatatagttgtatgtggaatctcatggaaaagaattattactttttactatgaagagttagagaagagtggaacaaattatgaattattggattatttaagtgaagattttaaaaaaataaataaatatccaacaataaaaaaacagtcaataattgatggaagttatatgaattattcttttgatttagatagtgactttactagagttttaaaaggtatactaaatgattatagagataatttagatgattatatgttaccttggagattatttataactaataatgcttcagtagaacgtaaaaaagtattagatgttggaatgtttgatgaggcgatagttggatatgggtttgaagattatgatttaggaataagattgtataaatctggcggtaaatttatttatgatgaagatattttaagtgttcatcaagaacatcctacaaatattaaagcagctgagattggtacaaatacgatttatatgtgtaataaatataataatatctattttattgatgtaatattagtctgtatggcatatgcaacatctattaatccttctaatcttaatgaattggttaaggatataaataaaatgttggaattaagctattttaaacagcttttaaatatatttttagagttgcttcaaatacgtagaaaacaatttttcaaagaagatatttataataactatagtttaatttatgctaaaaatatcgatgtaattaaattgataaaagaaatgtatatcttacagaattcatttggaatcaaatatttttcacaagctatgcttggattgataaatgatgtttataactagatttttaaagaaattttaaggaggaattatgaaaaaatatcatttttcaatgattttatcagagtttcatttatttaaagttttgcctatgtatgtttctttaagtaagtattgtgatgattttgagttatttattttagcaatgaatgattctgttgataaagtattgaataaaatagggtttgaaaatattactgtagtaaaattagaagagttagaaaaaagcaatactaatcttactatagctaaatctaatagaacatttcatgaatattgctggactttaaagccagtatttttagaatatattattaataaatatagtgatgcagtgtactatgctcatgtagatgcagatttattctttttttctaatatagattctatttttaatgaaaattctaatgcatcaatttttctaacagatcatagaaattctgaagaatttatgcattactatgaattaagtggacagtttaatactggatttgttggattcagaaataccgatgaaggaaaagcagctataaaactttggagagatcgttgtttaaaaagatgtactgcagaatatgatactattaacaaaacatttggtgatcaaagatatgttgaagattggattgatatatttaaagatgttcatgtggtaaaatctattggcgcaaatgtagcattttggaatgtaaaaaattatgagttttctaaagtagacgacttgatttatgtaaataatcagccattaatattttatcacttttgtgctcttgtaactttaggacctaaagaagtagaattatgttcagtgtacactataaaagatagagaactcttaaatttagtatatgaaccatatattaaatatttatcatacgggattaatgaacttaaaaaagaatttccgtggtttaattcaggatttattgataaaaataatattagtgaatttaagaattatagaattatatagaggggttaaaccctctatttttatatatctgaaaagtacacaataatatagtatttaatatacctattaatagtattattaacttctttataagttttatgatgctttgacatagtattgaaatccatatgattaatacatttatatatacatactgcctataaaaaggaagatataaagaataaggacaagatatagctatgtttgttatgaaaaacttaatattttaaagaaatatagaggtattaccaatttaaacggaatagtgtattaatacaaaaagtgatataattaattgtattaatacataaattacagaaaaaagctttaaaggaataaattaatataattgtactaatttattttgagtggtgcatcacaaaacaaacagttgataaaaagtccttacattaataggattttgaaaaacaagtataaaacacaagaaagatgaggtactataatggctagaattattatggataatggaaaacaatataatgtagatgaaagagatctggatagaataatgtatgaaacaaaaagctttgcaggagtacatttaagagaaggattaataaaattaccaggtcagaatatagccataaatcctaagcatatatcttcagttgaagaattggaatcatagtatattaatttaacatataattagagaattatcacacttttggaagtttgggttattccctaatataaaattttgacacaaataaatcctctaaattattataataatggattttatttatataaaaaactgctttattaatttgccaccttttataagggggcattttttattttcaaagaatatagatttgactaaattaaaaaatattcttaaaatataaataactaaaattacaacatggatgcacaaataaatagagaaatgggtgaacaaaatgaaaaggtttataaaagttatgatagctgttatgtgtatgatacctgtacttcttatgggatgtggtgtttcacaagacagcaaagaaaacaaggaaagtcagtctatatcagatgaaggtacagacaacaatgctacagcatcaactgaaaatttaccaatagcaactatagaagttgatggatttggaacaataaaggctgaattatatcctgaaatcgcaccaaatacagtaaataactttatttacttagccaatagtggattttacgataatttaacttttcatagaattataaaagattttatgattcaaggtggagatcctaacggaaatggaactggaggtcctgggtatagtatagaaggagaattcacttctaatggaactgcaaatagtttgaaacatactgaaggtgtactatcaatggcaagatctcaagatcctaatagtgcaggaagtcagttctttatcatgacaaaggcagcttctcatcttgatggggaatatgcagcttttggaaaagtaataagtggtatggatatagtacatgaaatagaaaatgtaaaaactggttcaaatgataaacctaaagaagatgttgtgattaagtcaataaaagtagatacaaagggtgctgattatccagaacctgaaaaacattaaatagatgattaaaaaggaattgagaaattgttctcaattccttttcgttttgattatttttttattattaaaaaatttgatattactcaaagtgtcaggataaaaacaaaataattgtttctatccttatttattaagaataaatatacataattattaatataagtagttaagatgaaattttttatagaactagtaattaaacttaaaaaaattagtcatactgtaaggttttaaatgaatatattgtaattaggagggggagtgttcatgagtatgaattttaaggaatttataaaaactgacagagagaaggctaatacacagaaatttgaagggtcttttttagaatatcttgatattgttaaggaacatcctgaaattgttcaattagctcacaagagactttataacatgattatggataagggtgttgaagaactaaaagccgatgaaaatccaagagtaagaaaaatttatggaaacgagattattaggaaatatggtttcttcaaagatgatttctatggtattgataaagttattatgaaattagctaattactttaagtctgccgctatgaaaggtgaagaagcaagacaagtattatatttagtaggtccagttggtgctggtaaatcatctatagttgaaagtttaaaatcagcaattgaggattgtgaacctgtatatgcattaaagggatgtcctatgcatgaagagccacttcatcttattccaaagcatttaagaccaaaattcgaagaaatgctaggtgttcagattgaaggtgatttatgtccagtatgtaaatacaaattaatgcatgaacttaatggtatgtatgaagaatttccagttgaaagagtaggtttttcaattagatcaagaaaaggtgttggcgtagttccaccagttgatcctaacaatcaagatacttcaatactaacaggggcaatcgatatttccaaaatggatttatattcagaagatgacccaagaattttttctttaaatggtgcttttaatgttggtaatagaggccttgttgaatttatagaagtattcaaaaacgatgttgagtatcttcatacaattattacagcaacacaggaaaagtccgtaccatcgcctggtaaaggatcaatgatttattttgatggtgttattgttgctcactcaaatgaggctgaatggaacaagtttaaatctgatcatacaaatgaagctattttagatagaatagtaaaaattgaagttccttactgcttagagcttgatgaggaagttaagatatatcagaagattttaaggaagagtaattttaaagctcatattgcaccacatacaattgaagttgcagcaatgtttgcaattctttcaagacttacaccatctgctaaagctgatagtatgaccaagcttaagatttataatggtgatgaaattgttgaaaaaggtacaacaaagaaaattgatatcactgaacttagggaagaagcaggacaatatgaaggtatgaagggtattagtacaagatttataataaagactatagataatgctcttgcagaatcagaatatgactgtataaatcctttaagtgtaatggaaaatataattaaatcagttaaagatatggatattgctagtgatgataagaagaggtatttaggatttatccaagatactatcagaaaggaatataataagattcttgaaagagaaataacaaaagcatttatacattcattcagagaacaggctgaaagtttatttaataattatatagataatgcagaagcctatgttaataagacaaagattaaagatgtttcaacaggtgaagagcttaatcctgatgaagatttcatgagaagtatagaagaacagattggtgtttatgcagcatctgctaagggatttagatctgatgtaacttcttatatgttctatattataagaaaaggtggtaagttagattatacttcttatgagccattaaaagaagctatagaaaagaaattaactgaatcagttaaggatttatctagaatcattacaaaatctaaagtaagagataaggaacaagcagaaaaatataattctatggttgaagaaatgaagagaaatggatattgtattcactgctgtgatgttatattaaaatatgcagctaataacttatggagagactaatagattatggctatatttagagactatacaagcaatccagttgatcatgatagatccatagaagatagaaggagacatagacaacttgttgaaaaatcaattaaagaaaatctaggagatatactatcagaagaaagcattgtaggtgaaagtaaaaataagaaatttaaaattcccattaaaggaattaaagaatatcagtttgtttatggacgaaactcaaagggagtagccactggagttggagatgaacaaagaggagataaaataggtaatggtaaaaagcaacttgcccaaggaaatcaaggagcaggtaatgatgaaggtgatgatgtttacgaaactgaaatcactcttgaagagttaatggattatatttcggaagatttaaatcttccgaaccttgatcaaaagaagtattctgaaataattactgaaactactggtaagaaacgcggttatcagactcatggaataaggcctcgtcttgcaaagaaaaagactgttatgagtaaaatagcaagaaaacaaggaaaaaagagagcccttcatgaacttaaagaggatactgaacttgaaagattcccatttagagaagaagatttaagatattatagagtaaaaatgaaaccaagaagagatagtaatgcagttatgatatttataatggatgcatcagggtcaatggatacgactaaaaagtatcttgcacgatcttatttcttcgtccttgcatcatttttaaagagaaagtataacaatattgcatttgaatttatatatcataccactgtagctaaaagggtagatgagtatgaatttttccataagtctgaatcaggaggtacctatatttcaagtggtataaatgaggcactgaaagttattgaggataaatatcctgcagccgtatggaatatatatcctatatacgctagtgatggagataactggtcagaggataatgaaaaggctattactgcagttaaaaagatatgtgagataagcaatatgtttggatatgcagaacttcttccatccacatatacaactacaatgtatcataaattcaagaaggaaattacaaatgaaaattttgtaccagtaataataaaggaaaagaaggatttatgggatgcgcttaatacaatgctaaggaaggagttaaaggaggaataagctgtgaagtatagtattagtgacttagaaaaatggaattcagaaatagaggaaaaagttaaggaatacggacttgacttttatcctcaggaatttgaaataataggctttaatgaaatgattggatatgaagcttatgtaggaatgccatcaagatatcctcattggagctttggtaaatcctatgaaaaaagtaaaactctttattccttaaatcttacaggtcttccttatgaaatggtaattaactcagatccatgtcttgcatatcttatgaaggataatactttattattgcagattcttaccatggctcatgtatatggtcataatgatttctttaaaaataatagattgttcaaacaaggtacaaaggcggagtatacgctagaaatgtttaaccttgatgcgaaaataatacgtgattatattgatgatccaagcataggttatactaaagttgaaagaattcttgatgcggctcatgctataagattccatgtaggaagaagtgtaggagtaaaagaattatccaatagtgaaatacaaaataatattattaaagaatatgaaagtaaaagggaaaacagaggcatattagattctcatgttgaaatagagcttccgaatttagataaaattccattagaacctgttgatgatgttatgggatttataatagaatacggaaatctagcagaatgggaaaagacagtattaagaatagttaaaagagaagctcaatactttattccgcaagttgaaactaaaataatgaatgagggatgggcaagttatactcattacaatatattaaaacaattagatcttccacaagaacttcatcttgaatttttgaagaggcacaatgatgttatagctccagctataggcggtttaaatccatattatgtaggttttaaaatattcgaagatttagataagaagtatggaaaagaaaagatttttgaagttagggaagttgatagagatgcttcatttttaagaaggtatttaacaagggaactttgtgaggaattaaatttattccagtataatcataggacatttgatacaataattgaagaaatatcagatgaagatggttggaaggttattagagatactttgagttatacagctggaatgggtggaataccttatgtacgagttattgacttgaataagaaagataatactttgactttggaaaatatatttgatggaagggctttagacctgtcatacgcaaaggaaacattgaaatatatacaagaactttggggatatgatgtaaaattaattaccaaaggtacagataaacaagaaattgtgattaaatgtgatcaagataaaaaattaactatattataaaaatgagactctgtagtatgtaaatactatggggtctttttaagtaaccaaaaaatactacaagaataatataattatatggaaaaataacttaggagattaaaatgaatttaaaaggaacaaaaacagaaaaaaatttatttaagacatttgcaggggaatgtagagctagaactaagtatgatttatatgcagaaaaagctagatgtgatggatatgtgtggattgcagaagtttttgaagaaactgcaaagaatgaatatgctcatgcaagagaatcttataaaagatatttagataaaattaattgtacaaaaaataatcttattgagtcagcagttggtgaatcagaggaagctaatataatatataaggaatttgaaaaggttgcaagagaagaaggatttgaagagatagcagatttttataaagaacttcaggaagtagaagaaagtcataaagaaagataccttgatttagcaaagaaactaaaagatgataaaatctttaaaagtgatgaagatacattatgggtttgtttaaactgtgggtatattcatgaaggaaaagaagcaccagaaagatgtcctttatgtaaataccctagggcttattttaaaaacttagattctaagatatgcaaataggagggattatattatgatatacgtttatccagacaattttatagttccagtaatatttgtagaaaattttatgaataagggaactaaggaaaagaaaagtgaaaaaatagaagtagaaaaatgcataaaagaagtagtaaagaatgatgaacaagaaaaatttcggaatgatgataaaaatgaatgttatgagaaattacaagaagaacttgttatggaatgggaatatgaaggaaaacattcacaaaatatagatgacaaaaaaatgttagaaaaaatagataaagagtattctgacggtgaaactgaaaggatttaatcatgtaaaaaaagcatatttaatatactaaataataagaataataaaaaggaattaatgtatatgaaatatgatgacttagccaaaaatcattatgatgatataaataatctgtgcaatcttttaaataactatgttaatgcatatagattattaatagcaggagcatcagaattatatggtgtaaatattgctaaaaaaggagatataaagaaggcgcttgatagagtagatggcgttggagacttgatagacaatttaattgaagcactagataaatgtgagaatggatacttaaaatattgtaagataaaaaatgagtacttgtcagtgaagacacagaaaagtgagatatatactgaaatagataatgaattgaatttccaaaatacaggacgagattctgatgaggatgaagaagaataaaaattagagctttgaattttattcaaagctctaatttatccattatacttttttaaggtgaactttactcaccattaaataagatcctgcaatcataagaataacagttatataagtatgaattgtatttaattcaacgttaaataatgttaataaaaatgaaaataatgccataaagcatccaacaattgttattggaaccccagtaaatacaccgtcaaattgagcagtattaaaacgtgctaatctgtatgcaccgcatattgggaatgttaataatattataaatccgataatacctaaaattccaggttcattaagttcgaacagtgtataaattaaaatagaaggtgctactccaaaagaaacaagatcggctaaagaatccaattcttttcctaaatcacttgaaacatctaaaaaacgagctacacgaccatcatacctatccactaaacctgctaataaaataaagacacttgataaagtatattgtttattcattactgataatatagacaaaattccgcaagataaattaataaaggtaaatacattaggaatacaacttttcctcataaaatcactcctagaattatataaaatacttacaaagagttattatagcacattattatgaataatataaggtataaattaacctttaagaatttattaaggaataatttagttattcatcatgtaaataattattcaaatatttgaaaaaaatatatacaaaggttataataaacaaagattatctttagaggaggtacggttttattttgaaaaaggttagatttatatacaatccatattcaggggaaaatagtataataagtgaattagatagtgttataagactgcatcaagaagttaatttaacaatagttccatatagaatacaaaaaggaagatcattgagtgaggctctagatattgtagataatacatatgaatatgtattagttgcaggtggtgatggaactgtagactcagttgtcaatgcaatgaaggaaagaaacattgatataccaataggaatacttccagttggaacagcaaatgattttggaaagtttataagcatgccttcagatattcaggaagcgtgcaaacagattcttgattcaaaaccagttccagttgatgttggaaagataaacaataaatattttgtgaatgtagcaagtacaggattatttacagatgtatctcaaaaaacagatgttaatttaaaaaatactataggtaaactagcatactatttaaagggtcttgaagaacttcctaatttcagaaacctaaagataaaactttcctcaagagagtgtatgtataatggtgacatgtatttaatgttagttttcaatggtaagactgctggtaattttaatttggcaactcaggcagaagtagttgatggtaagcttgatgttataatattcaaagcagttccaataatagagcttattccattatttatcaaagttcttaaaggtgagcatcttgattcagacaaggttgtatattttaaaacagatgatttatatattgagtctgatgaggatattgtaacagatattgatggagaaaaaggtccagatttcccattgagaattcaatgtattaaaggtggaataaaacttttaggtataaaagaagatatacaataataaatataagtaacagaaatagtgattggagtgtaagtgcgttgaattttgcatactatatatttttgttgcttataatttttttgtgcttttttacaattaaacgaaatttattagtatcacctaaaaagataaaaatatattttactatagttattgcattactgttaataaggcatttaggacttgtttcattatgcatacttgagagcagtaaatatatatattatttaaaatctattatttatttagataatattgcagttcctttaatagtattagcagtaacatatgtgtattcaagagcagaaaaactaaaatttacaggtagctattttatccttgcagcagttctgttagtttattcaagcattatatacatgtcaaaggttatggtaaatgtaagtaatatttatggatttattatgtcaataactaatgaaatagtaatatctatgttctcattaatattgctaggtataatgctaataataaatgttcttttattagatagacagtatgttaataaaaagggaatatggtttataataattgcgattatggctgtaatgatagaaaaagtaataatacttggaggaattagagtttttccttattcagttataggtgaattgatttttattataataataaattttgtacttaatgggtttaaaaaaatcaaataaaaaatttaggaattaacagtattatataatgttaattcctaactatttaagttattttaatctatacaccatagtcacaaagtcttccagaataaatcaaatcaagatcagcaattgatttgaaatcataaggtctcataagagtgaagtgcttgtcaaattccatcacatttgatttttcaagtacatatgcaacaaattgtgaacatacataatgttttggtctatgatatggaatattgaaaagaattgcgattagtcctgcaaaattatatttgtatttatcttcattttctttaaattcttcaatagacttttctaaaagttcatattgttcctttgtgattttcaatctatatatttcacataaggtattgccatgaattttatatattccgctgtttatatcttctttaacaaaaccagcaattaaaggtacatacaagttttgccttgcaaaactgtaaagagaatttaaattttcatcaagtgctatagatgcatgattgtatggtgcacgtgtaaaaaactgaagtattctcgaacatccagtattagtctggcttatcataatataaatattttttttcataattagtcagttccccatttcaaatatatacaattaaaatttagcttaagactttatgctatatagcttaagattttttattataaagatattatagatgtcatatataaagatattataaaatataaataagaaaatcacaaaatttttttatttagaataagcagatagaagaaactatctgcttattcatttaatgaattctttttttattattagttgactttctagtagtgttttttgaaagctttgagttagtttttccagatttactatttgaatttttagatttttgtctttgttctctagaatttggagtatcagatttatttttattgtttttaccttgatatcctagttttttaggtgcaaatcctattaaacagtcttttccgttacctattaaatcttctctatgagctttaattaaagcttttttaacttttggatagttctttggtacagcaaattgtattaatgctctttgcatatctttttcttcctgagttttaggtgtataaacttcttcaccagtaagtggatttactccggtataataaatagttgtagataaacttccaggtgtagggtagaagtcttgaacttgttcaggagtatatcccatctttttaacatattgtgcaagctctatagctgcatttaagtcagaaccaggatgagaagacatcaaatatggaacaaggaactgtttctttccaatcctattgtttatttgaaagtatttatcaacaaacttatcataaacttctcttgtaggtttacccatttggtttaaaactcttggaacaacatgttcaggggcaacctttagctgaccacttatatgatgttcacataattctttgaagaatgattcattatgatcatgaattaagtaatcatatcttatacctgaacgaataaatactttctttattccaggaagttttcgtactttctttaaaagagaaagatactctgtatgatctatgattaagtttttacaaggtttaggaaacatacattgtttagttttacatgttccgtgtacttcttgctttttacatgctttatgtctgaagtcggcagtaggaccccctatatcgtgtatgtatcctttaaaatcaggaaaagtagtaagtaatttcgcttcatctataattgaatcctgacttctattttgaatgactcttccttgatggaacgttaatgcacagaatgaacaagaaccaaagcatcctctgtgacttgttattgaaaatttaacttctgtaattgctggtataccacctttttctttgtaaatagggtgatatgttcttgtgtaaggaagattatatgtaatatccatttcttcttgtgtcatattttcttgaggtgaattttgaacaagatatctgtcaccgtgtttttgaattatagttttacctaaaattgaatcttgttcataatattcaagtttgtaggcttcaccatatgcttttttatcactagaaacttcttcaaatgaaggaacatgaattgcattttttatgttagatatatcatttgtaaggtaacatgttccacgtacatttgttatgttctttatgttggctccatatcttaataaatcagcaatttgaacaacagttttttcacccataccgtacattaataaatcagcttttgagtctactagaatacttcttcttactttattatcccagtaatcataatgagcaaatcttctaaggcttgcttcaataccaccaattgcaatagctacatctttataagcttctcttattctattacaataaacaattacagccctatcaggtctatgtcctgcttcaccaccaggtgagtataaatcttcatgccttactcttttagcagcagtataatggttaaccatagaatctatattacctgagttaactagaaatccgaatttaggtcttccaaggcgtttgaagtcttcacaattatgccagtctggctgtgcaattatacctacagaaaatccttgagcttctaatgttctaccaattatagcagtaccgaaagatggatggtcaacatatgcatcaccagtaacaataataaagtctaattcttcaataccgtttctacgcatatcttctttgcttataggtaaaaattctttattaagcttcataatatttattaactccaattcttaaaaatattttatccacaaattaattgtttgaatagtaatattatccacaaatgtaaaaataaaatgtggataatattgaaaatttatatatattaaactataaatgttgcaattataatttagaaatcacaaagtgattttaaaatgacttttcaattgttaatttaaatatatagtcttaatgtatattaacataagcagtgatagtttacaaaccaaattcattggaatgagtaccattaaattaataaaactttaggtaaatattaagaattttattgccttttaatttctatgtaatataataaatatggactaaaatcatattaattcaaaattaacaacaaacaattggcaattatgataaaaattatgatattatcaattgttgcttttaagatatataattatttcttacattttaaataaagtgtaagtatttaattttttgaagaaacattttaggagaattaattaaaagactattaattgtagatataaaaaatgggtggtgtaaaaaacatggaggaaggacctcagaatactaattgtcatacgagaaaattaaatatttatggagagaattcttttaaggttgtatgctgtttatttaattttattatatataaatagtagttactagttatgcaaaaaaaggtaattaataattaaagaattctttccgctaagaagtaggaggaatctttattatggaattatcaatatttctatataccaatatattaaatcgaaaggtttatgatgaatttggtgatgtacttggactgttaaaagatgtttatgtgactacagaagaaggttatccacgaataattggatataaattaaagaaggatggagttacttttcactacgaattcagatatatacagtttatagataatgacggtaaaattagaatgaagacaagaggaagtaaagagatacttccaatgagatatagttatctgttatctgaaaatcttcttgataaaaagattgttgatattaatggtaaacaagttgttcgtgttaatgatcttagaatagcaaagcttgcaggtgaatttagagttattgcagttgaagtaggaccttttgcaagatatagaagattaaaaatctcaggattaatgaagattttatataagataataggcaaagatatagaagaaacagttttaagatgggatgatgttgaatctcttgaaatggttaataataaccttcaaatatcagttccatataaaaaactttcaaaattgcatccagcagacttagcagatatacttgaaaatcttgatactaattcaagaaaacaggtattagaatcacttgatgaagatttagcagctgatactcttgaagaaattgattctgagtataagggagctataattaaggaattgtcagacagtaaggctgtagaagttcttgaaaatatgccaagtgatgaaattgcagatttattagatgaccttgatgaagaagaaagagagaagattttaataaatcttgaaagagaagatgcagaagaagttaaagaacttctaaagtatgaagatgagacagtcggaagtataatgagtaaagaatttatttcagtaaatcttaatataacaataggtgatacagtagaaattttaagagaaatgaaaccagatgaagaagctatgtattatgtatatataactgatgaagaagagaatattgaaggtgttattcctataaaggacctaattttatattctcctgaaactaagataaaagaaattatggatacaacagtatcacgtgtaaaacatgatgatgaaataaataaagtaatagaaaaagcagcaaaatatgatttgatttcagtgcctgtaacagatgaaaatgataagcttataggcatagtaataatacatgatatagtagatgaattcttgtatcctttatggaagaaaaagaattaagaatagtcaacacttttggaaaaatatttaaaaaagtgttgacttttttatattttatcatataataaaaatataaagtttatcaaaacactcagaattaaaaactatgaaaaaggaaagtagcatattggaacgttaacagagaggaaaggaagctgagaactttctatcaggaaactatgtgaagtgccctttggagttgaaatctgaatagtagtaagattctccgggttcacccgttatagtgataggcatgattagtgctcgatttgaggtgggattatattaatccaattagagtgggaccgcgaagtaacttcgtctctataagtatatagaagatgaggtttttttgttatataaatctaaattattagtgcacgaataatttttggactaattaaaaacatatggttttaatatctccgtttatatgataaaaagcagtaagccacatgaagtattcttcatgatcgggacttaatctatatttaggaattactaatgacataaattgaaaattaaatgataaaaatataaagtataaaaataaatgtttttgggaggacgaatatatgatttataatggagttttagaattagtaggaaatacaccaatattaaaggtgaacaatttaataaaggaagaaaatattgcggatatctatgttaagcttgaaaaattcaatccaggggaagtgttaaggatagagcggcacttggaatgatagaaaaagctgaaaaagaaggtttgttaaaagaaggatccataattgtagaaccaacaagtggaaatacaggaatagcattagctcttattggaggattaaaaggttataaagtaataatagttatgcctgagacaatgagtaaagaaagaagagatttaataaaggcttatggcgctgaacttgtattaactgaaggatcaaagggaatgaagggagccatagaaaaagcattagaaataggaaatggcgaagaatatttcataccacaacagtttgagaatttagcaaatccagaaaaacattatgaaacaactgctgaagaaatatataaggatattccagagttagatgcatttgtttcaggtgttggaacaggtggaacattaataggtatttcaaagaatttaaaaaagaaaaatcaaaatatcaaagcaatagctgtagaaccagctaactcaccagtattaagtggaggcaatccaggtggtcataaaatacaaggtattggagcaggttttattccaggtatatatgaacaagattttgttgatgaaataattaaggttaaagatgaggatgcttttaaagctgcaaaatcttttgctgaaaaagaaggtgtacttgtaggaatatcagctggagcggcaattcatgcagcaattgaaatagcaagaaagcttggaaaaggtaaaaaagtattggcaatagctccagatggaggagaaaaatatatatcaatgggactatttgattagttgatagttaaaagttatcagtttacagtcaagttggaaatatcattcttaactgtaaattgataattatcaattatcaattggacttgctgaataagtactataagaaaaggagaaataagctgtgtttaaaatactcaactatgatttagaaagaatattaaaggaagaccccgcagcaaaaagcaaaatagaagtattattattatatccatgtatccatgctttaattgcatatagagcttcacactttttttataaacacaaaatgttttttttagcacgtttaatttcgcagatggcaagatttttaacaggtatagaaattcatccaggggcaacaataggaaagggattatttattgaccatggaatgggtgttgttattggagaaacagctgaaataggagataatgttactatttatcatggtgttacattgggaggaacaggaaaacataaaggtaaaagacatcctaccattggtaataatgttttgataggtacaggagcaaaagtactcggacctattacagttggagataatgctaaaataggagctaattcagttgtacttcacaatgttccagagggagctacagctgtaggattaagagcaaaaaatattttaaaaagtaaggctaaatcatgtataatagaaataaaggatttacaggggcgaaagaaaaaaatatataacgatatgataatatagaggatgaaacatgggagtaaaagaagatataaaaaactattgtttttctttaggtataaattcagtgggatttattaaatgcagacgctttgaagaactgaaagcattttatgaagtgagaaagtctttaaatttacaaaatgaatttgaagaagataatatagaatcaagaataaactcaaaagagtggtttgaagaggggaaaactataatttctatagctttcccctatgttttttcagataacaatttaaaaacgaaatcagaaaataatttttcgatttatactcaaggacttgactatcatcatgtggtgaataaatacttgaataaaatttgtgaaataatagaagcaaatggaggaaagtataaaacttttgtggatagcaatacattacctgagagatatcttgcatatatatcaggagttggattcataggaaaaaataacttgataattacaccgaaacatggatcttatgtgtttttaggagaaataataactgatttagagatttatgatgaagataaaagacattttgatgaaattgatttattcagagaatgtggagagtgcagtatctgttatgataaatgtcctacaaagtccataaataatgtgagaaaaaattgtaatatatgcttatcatatattactcagaaaaaagatttaagtgattgggagataaaaaaacttgatggcaggatgtttgggtgcgatacatgccaattgggatgtccgtataattctaaaatagaaaaatcacaacttaaagaatttaaaccattagattggttttgtgattatgatgaagattatattattgatatgaataacagcatgtttaaagaaagtttcaaaaagacatcgtgtgggtggagaggaaaaaatattttaaagagaaatgctttaataagaaaatatatttttaaaaatgaatccatagataatttgaaaactgtaaaattcgaatctccatatttagaagaatatttaaaaagaattgctgaaatgaagagtgataaggtattgaaaaaatagagtaaatattttacaattaattaggggtttattaaactatatgaaataattattaaatgtaaatatgtagattacataaaccatataatgtagttttgtttttaaattgcaaggatatttaaaaaaatatataatataatagatttactattgagaaagggtgaatgaaatgttatcaccaacagcagctaaaattataaatatgttgccagaaagctttttggtaaaaatggcaagaagaatttctaatggatatattaataaatatgctaatataacagtgcgtggacttgaaaatattgataatgtaaagaaaccaagaatatttgtatgcaatcatttaagtaattcagatggattagttttaaataaaattcttaaagaaaaaagtgatccttattttattgctggaattaaactatcaaatgatcctataactaatataggaactaagattgttaaaaacattgcaataaagccaaattctgctgataaggaagctataacaaaagttgttaaagctttaaaaagtggagaagatattcttatatttccagaagggacaagaagccgtacaggtgcaatgattgaaggaaaaaaaggaattttattatttgcaagaatggcaaaagcagaaataatacctataggaatgtcaggtacagataaattacttcctatcagtaatgatggaaatatgggagcagaaaagtggcagagagctgatgttactataaatataggtgacaaaatccaattccctaaaagggaaaaagatgaggataagcatgaatatgaagatagatgtatggatacactaatgagaagtatagctagacttttacctgaacattacagaggggtttataaataaggagcagattaaatgaaggcaaggacaaagaaaattgtagaaattttaaaagaaacttatccagatgcaaaatgcgaattaaattatgaaacaccacttcaacttcttgttgcaactgtgttatctgcacagacaacagataagaaagtcaatgaagtaacaaaagaattgtttaaagattatcctgatttagatgcatttcttgaaataactaatgatgaacttgaagagagaataaaacagattggtttatatagaaataagtcaaaaaacttaattcttatgtttaggcagataaaagaaaaatttaatggagaggttcctacgactatggaaggtataacatctcttgcaggagctggtagaaagacagcaaatgtagttttatcaaatgcatttggagtaccttcaatagctgttgacacccatgttttcagagtctcgaatcgtcttggccttgctgaaagtgataaggttcttgaagttgaaaaacagcttcaaaaagaacttcctaaaaaagaatggacattaatgcaccatcttttgatttttcatggaagaagatgttgtacagcaagaaatcctaaatgtgaagaatgtcctttgagtcatatatgtaaatatgataaatagtattaaatgaaccactttttatgaaaactaagtagatagtggttcttttatttagcgtgtatttttattacaataaacatatgaagaaaatactggaggtaaataaatgaaaatcggagttataatgggtggtatttcatcagaaagagaaatatcattaaatagtggaaaatcaatagttgaaaatataaataaagataagtacgaagtagaagcaatcgttatagataaaaaagaagatatagtaacaaaagttaagggcatagactttgcacttttagcactacatggacaatttggtgaagatggaacagttcaagctgtacttcagacattaggaataccttattcaggatgtggtcctttaagtagtgcaatgtgtatggataaagatgttacaaaatcaatacttcaagctgctaaaataagaacagcaccttggattaatctatctaaaaatgataagatagattatgatgctattaaaaagttaggatatcctgtagtggttaagcctactcatggtggttcaagtgttgcaacttttatagttaaagaagaaaaagaaattgaagagtgtgttaaagaaggctttaaatgggacagtgaagttatgattgaaaagtttattaaaggtgatgaaataacatgtcctgtttatggagatagaatgcttcctgtaattgctataaagccaaaagctgaattctttgattttgcatcaaaatatcaagacggtggagccgaagaagttgtggtagaattagataaaaatttacatgaagaagttgaaaaaatggcgttagctacttacaaggctttaaagtgtgaagtttattcaagagttgatatgatagttacgactgatggtgttccatatattttagaagttaatactttaccaggaatgacaaaaaatagtttgataccaaaaagtgctgcagcagttaacattgattttgctcagcttgttgatatgataatagaagattcaatgaaaatttcaagataactaaattagctgcaatcgaatgattgtggcttaatttattatttcagaaaatattaagaagttatagtacttttattaaggagtttaggctaaaattatagtataaaatggatttagttcgtacttaaaaatataacttggaggaagagtgtcaatggaaaatggaagcatattaatagttgatgatgaaaaagaaatacgtgatttagttgaaatatatttaaaaagtgaagggtataatacacttcaagcatgtgatggtcttgaagctatagatataattgaaaacactgatgtggatattgttatactagatgttatgatgcctaatttaaacggaatagaaacttgcttgaaaataagagaaatgaaagaaatgcctataataatgttatctgctaaaagtgaagatatagataagatattggggcttaatatgggggctgatgattatttgtcaaagccatttaatccactagagcttgttgctagagtaaaatctcaacttagacgattttataaatttaaaaataaacaggacgttttatataaagaagatgagaatataataagaattgaagatttaacaataaatcttgatactcatgaagttaaacttggagatacattcctaaagcttacaccaacagaatttgatattttatcattactttcaaaaagcagaggaaaggttttttcaatagaaaatatctatgaaagtgtatggaatcaggaatttatgacttctgataatactgttatggttcatattagaaagataagagaaaaaatagaatctgatcctagaaatccaagattcattaagactgtctgggggtaggctataagattgaaaaataataattttaaaaataagatggagagcaatattagtaaatcttatactaaaattctagattatatagaacattttatatctgtaactaaaagaaaaattgaaaaaagtataaggtttgagcttatgcttgttatagcaatatgctttcttatttcattctttttttatacatttacaaataattttttaaaaagagagtatacagagccgcagatatcatatgattatgaatcagttgaaagacttgcaagcgagttgggatctaaaattgaaaatcagaatatattgttgaatgataaagattctataaatgcaattttaaatacagtcccttcaacagataaatgctatattactgatcttgatgggaatgtgctttttaagacagaaggggtgtcagaagagacaatagacatatatagtgcattaaaagatgctatgactaattttaattatgagaaaatgggtgtggtaaaagaaaagaaatatataatgccacttaaaattggtgaggatagggtctacttaatatatagtaaagttccggaagctaccataacgtatacaacaataagcaaatcaaattcatcattagcagtatttttaacatgtattgtgtttattatttcatttgtaataataactaatagtaagatgaaatatttagatgaaattgctataggattaaaaataatagccagtggtaacttgaattacagaatagaagaaagaggaacagatgagataaaaactatagcatacaatataaactatatggctaaggaaataggggaaaaaataaatgctgaaagagatgcagaaaaaactaaaacagatttaataacaaatgtttcacatgatttaagaacaccattaacatcagtgatgggatacataggacttgttattcaaaaaagatataaagatgaaggtgaaatgaatgaatacttgaacgtggcatttaataaagctgaacgcctaaaagtacttattgatgatttatttgaatatactaaatataatagtcatggaattactttaaataaaaattcggttaatttatctgaatttttatctcagctgattgaagaattgatgcctgttttggatgataataatcttacagtatttaaaaaatttgaatgtgatagagtttttgtacagatagatcctataaaaatgattagggtttttgaaaatttacttaccaatgcaataaaatattcatataaacctggagaaataattataggattatatgagaaagacaataaagcaatagtggtattcagaaataagggagaacatttaataaaagaaaagacagataaactatttgataggttttatagagttgatgaatcaagaaacactagtacaggtgggtctggattgggtcttgctatatctaaaaatattgttgaatttcatgacggaaagatatgggctgagtccattgggaataatataagcttttacgttgaacttgatatttttgaaatgaattagaacatattatcaaaaaataggtacttttttatgtgaatgttaatatttatatttagagaagtatttttatttggaggaaatatgcaagataaaaattctaaaagtctttttggtattgatataaatgagtatactaaaagtgtacagtttgacgtattagcaaccaaaatagattttttgtacttaagatcatcaggttcaggttctggaagattcagagtagataaaaagttttttgattttgcaaaatcaagtcgtgagtatggaatacctgtaggggcatatcattttggggttccatcatatgatcttactgatgcagacagacagtgtgatgactttattcaggtattgcagcaagggtttggaaataaagattatggagatttattccccgtattagatgttgaaacaccagtggatagatctatatcaactaaagttttagtagagtggattgatcgttttagaaaaaggtttgaaaagaaaacgagaagacgattgatgctttatacaggattattttttattgaattgtatgataatttttatgtatcaggaaaaggttatccattaaagaatatgattttgtggattgctatgtatactaatgtgccaattaatcctaaagttccgcctgatattggaggatggacacgatggagaatatggcagtatagtgaaagtgaaacagttcaaggagtaggaaatcctgttgatgcaaattggggacctgataatattgcattattaatacagcctgctactgtaaaggggctaaaagcacggttagaaaatggaaagatatatgtgtcatgggatagaaataatgacccagatcttttaggatataatatatttttaaataaagaatgggttggaacagtagatgaaaatgatacaagttatgttataagtgcagataaggtgaagaatataacaaccagacctttagaagtttctatagaagcttttgattatgatggagaaacttctaaaagtagggcaaaagtaaaattgtaagcacaataaaaaagatatatattccagtaatatgtaccttaaattcactatcataactataacaaaatatgatataatattaacattgatgacaatttatattgatataaattgtcatcaattatgtattcttataaaatatatattttttacgataaggtataagcttctgtgtgtattttaattaaatggaattattatctgttttaaatagggaagcttatatttatattttgaaaggggattaacaagtggaaaatggtagtggaagaaggaaatcctccagaaaaagtgcggctgcaaagaaaaagaagacttggattatgattgcaagtacattagcaattattatttgtggattagcagcatattcattagcagtaagcagcgcagttaaaaagtgggatggaaagatttatccaggtattacagttcaaaatgtaagccttgggggatgaccaaagaagaagcgaagataaagcttaaacaatcatttgaaggagaaatagataataaagttcttcctataaaaatagaaggaaaaacttttgagcttaattactctcaaatatcaccaacttatgatattgataaaactgtagaagaagcttttaatactggaaaagagcatggattattaagtaaatatttaagtattaaagggaagaaaccaagtgagatagagcttgctttttcttatgatgaaaataaattaaaagagtttgaagaaaaggtaattaaggaagttaacaaagaacctgtaaatgcatctattacaattacaggagataaaattcaggttaaacctgaagaagacggaattggagttagtatagatacactagattctaaaataaaagaagcattaaatggtgttattgaatctagttcagaagttgatgttgatgcagaagtaacaaaagcaaaaataacagctgaagatttatcaaaaataaaaaatgttatgggttcattttcgacaagctatggaacatcagcagcaggaagaagtcataatatagaactggcaactaaacatattaatggaactgttataatgccaggggaaacatttagttttaatgatattgtaggacctagaacagaagaagcaggcttccaagaagcaggtacttatgttggaaataaagttgaaccaggaattggtggaggaatatgtcaggtatcaacaacactttatagagctgtaatgagagctaatataagatcaacagaaagaacaaatcactcaatggcagtaggatatgcccttccagggttagatgcaactgttgcttatggatatctagattataaatttaaaaatccatatgattttccaatatatattcaaggatatactggaggtaaggtagttacttacaatatatatggtgatacaagtattttaggtggaaaaacttatgatatggttaatgaaatattagaaacacttccagcacaaactaaaatagttgatgatcctactcttgatgaaggcactgaagttaatgaaggtggggggatgacaggctatagagcatcttcatatcaagttacatatgaaaatggagtagaggtaaatagagaaaaaattgctacagatacatatactaaagttgacgtaacaattaaaaaaggtactaaaccagttgctaaggaacagccaccagcaacaacagaaggtagcgaagctggggctcaaccaggaacaagcactgaaactgaacaacaggcaccacaagcaccggcaccacaagcaacagcagctacacatcaataatattgtaatcactatgtggtttctgaattataattataaagttcgaagaattatttatttaatttttcgaactttattttaattaaagaaataaaaatatggtgtttttgacttgtaattaaccatatagtataattttaaaatggctaatataatttttaagaatattaaagagggtgaagttttgaattttaatatagtattgtatcaacctgaaattccacaaaatacagggaatatagctagaacatgtgtacttacagattgtaaattgcatttaataaaaccattaggattcgatataaatgaaaaacaagtaaaaagagctggattggattactggagtgaattaaatttagaaattcatgaaagttatgaagattttttagagaaatatggcaatgagagaattttcttggcaacaactcatgaaactggaacacattatgatgaaattgaatttaaatctggagattttattatgtttggaagagaaacttgtggtgttcctgaagatgttcacaatagacataaaggtttaagagtacctatgataaaatcaagtacaagaagtttgaatttatcaaatactgtagctatagtagcgtatgaagctttgagacaaataggatttccgaatatgaaatagatgaagaggaatgaagaagatggaaaaaataaaaatcataacagacagcactgctgatttaccacaagaattatatgataaatatgatatcgaagtgttacctgtactaatcaactttggagaagaaagttatctagatagagttgatatgaatgctgagaagttattaaagagaatgaaagaagaaaaagactttccaactactggtcaaataattccaaatagatttattgaatgttatgaaaagtatctaaaggaaggatataaaatattgaccatattaatgtcatctgcaatgagtggaacatatcaatctgcatgtattgccaaagatgcagtagaaagtgatgatatttttatagttgattctcaaaatatagctccagcattaggaattcttgtattaaaagcatgtactcttatggaaaaaggttatgatactgcaaaaatagcagaagaattagaaaaagaaaaaaataaagttgaaacaagaatgtgttttgaatctttagataatcttattaaaggtggaagaatatctaagactgcaggtgttgtaggaactgtattaggtgttaaacttgtactgaatatcaaagacggattaatgtcagtaaaagataaggttagaggaagtaaaaaagcattaagaaaaataattacagacttagaagcatcagaattggattgtgatgtaccggtattattagtatatgctagtgaaattgaaataaaaaaagaacttacagagtatttagaaaacaataatattaattatattgaatgtccacttggttctactgtttgtgttcattcaggaccggattgttgtgggttggtatttttaacaaaataaaaacaatgtctctatcaagatgtattcttgatgaggcattatttttttgattatatttatagaattttaaaagaatattaattatatcaaagtagtaaatataaataagtaaagtattaagattacttgctaaattatcaagaaaaaggttatacttaaagtaaatgaaatatcttcacctgaagttttgaatacgtttaacaaaaggtggagttgtatttgaaatagtatttattagaaattgatttttagtaaaataattagttttgtgtatagggggataattatgaatctggattatagtatgaaaatgacgcagcagcaaaggatgattatgactcagaatatgcagcagtcaattaagcttttacaaatgtctcttcatgatttaagagaatatatagataatgaatattcagaaaatcctattttagaaataaatgaacagagcagccaaagcgaagaaatacaaaacaatgatttaatagataaatataatgctgaaaaaatagcagaagaaatggattatgatagttacaaagataagccagaaagatcatactcaaatgaagatgtttcaccatttaattttatagaggaaaagaaatcattaaaagaatatctatacgaacagttattagaatctgatgaagaacagtatacaataatgatagctaaatatattattgaatctttggatggaagaggatatttagaaatatcaatggaagaattagcgacggaattaagaatttctacagatgacgttgaaaaaggattaaaacttgttcaatcattagaaccttatggaattggtgcaagaaatataaaagaatgtttaattatacagagtattaatttaaatatattagatgataatatagaaagaataattttagatcatcttgaagaagtagcggaaaataaatatgaacttataggaaaagcattgaaaatttcacctagagaggctcaaagatatggtgatataattaaaaagttagaaccgaaaccttcaagaggtttttatacgggagaagaagtaagttatataattcctgatgctgaaatcaagaatatagatggagaattttttatcataatgaatgaaggagtgcttccaaagcttataataaataaaacttacagagatgttttgaaaaatggaaaagatactgaaataaatagctatgtaaaagaaaaaattaataaagcaatgtttttgataaaggctatagatgatagaaaaaatactttatataaagttttagaatgtctgattgataaacaaaaagaattttttgaaagaggatattcatatattaagcctttaacattacgagaagtttcaagtgaactggatgttcatgattctactataagcagaacgattaaagataagtatatattgacaagttatggaactattaaaataaaagatctatttccaagcggaataactaataatacattagaagatttatctactgtaaaaataaaaaatgaaataaaaaagattatacaagaggaaaataagagcaagccattatcagatcagtctataagtcttatattaaaggagaataatattaaaatatcgagacgaacagttgcaaaatatagggaagaacttgggataaaatcatcttctatgaggaaaaggttataatattctattaaggcattcaaaaaataaagcaaaacaatattttttattatgtatgtatttaataaatttgataaatactaaaaaggaagaaaagtcatataaaaaatcttgaaaaattattgaatatttgttttataaaatttgaatgcctgttttattgctgtatgccttaaatagcaataaaacatataaaaggataatacatataagattacataattttatacaaaatatattcaaagttaatcctaaatggtgaaaatttttaaataattaaaaaaatttcacataaggggtttaaaatttcctaaaggtgttctataataatagatgtgggacataataaaatgatatgggacacataatgaccaaaggagtgtttaagttgcaggaaatattagaattacagaaaaagatagttcctgagcttgtaaatactttagaaaaaaggtataacgtactcagaacaatctatcataatgaacctattggcagaagaagtcttgctgaaaagttaaatactggtgagagaactgttagaacagaaataggttttttaaaagaacaagaacttatagaaataaatcctgctggaatgaaagttactgatgatggagaagaaattatcaataaattgaaagattttatccatgaaataaaaggactttcagaagtggaagaaaaaataaagtctttgttgaatttaaaaaaggtaattattgtttcgggagatgttgaggaaaatcctttagtcttaaaagatttgggaaaagcttgtgcgaattatgtaaaggatgtactggaagataattcaattgtcgctctcacaggaggaagtacattaaaagaagtagtggaagcatttccgaaagtaacaaatttatctaatattcaagtagtacctgcaagaggtggtatgggcaaaaatgttgaaactcaagcaaatacattagctgcatcacttgctaaaaaacttaatggtacttataaaatgcttcatatatcagaaaacttaagtttagatataatagataatttacttaaggaagaggctgttaaagcagttatagatactatacataaagctgatatactaatgtatggtgtgggaaatgctgttcaaatggctagaaaaagaggagttccagaagatgaaattaaaaatttaattgataatggagctgtaggagaagcgtttggatgttattttagtaaagattctaaaattatttcagaaactaccgcaattggtattaaaatcaacaatgccagaaaaataaaaacgcatattgcagtagctggcgggaataataaagttgaatcgattattgcaactgaatataatgactctactggtgtattggttacagatgaagctgcagctaatggaatactagaaaagttacaagagttcagttcttaaagtagtttgtaaaatttatttttataaaattttaaaataaatataataaaagcattattaggaggtaattgatatggtaaacgtagcaattaatggttttggaagaataggaagattagctttaagattaatgattaacaaccctgaatttaacgtggttgcaatcaacgacttaacagatgctaaaatgttagcacacttatttaaatatgactcagctcaaggtagattcgatggagaaatcgaagttaaagaaggagctttcgtagtaaacggaaaagaaattaaagttactgcaaactctaacccagctgaattaccatggggagaattaaacgtagatatcgtattagaatgtactggattctttgcttcaaagaaatcagcttcagctcacatcactgcaggtgctaagaaagttgttatttcagctccagctggaaacgacctaccaacagtagtttacaatgtaaaccacgacatcttaaaagcagaagatacagtaatctcaggtgcatcatgtactacaaactgcttagctccaatggctaaagcattaaacgatgctttcggattagaaaaaggattcatgactacaatccactcatacactaacgatcaaaatactttagatgctccacacagaaaaggtgatttaagaagagctagagctgctgcagcttcaatcatccctaactcaactggtgctgctaaagcaatcggattagttatcccagaattagctggtaaattagatggaggagctcaaagagttccatgtataactggttcattaactgaagtagtttgtacattaggtaagaaagtaactgttgatgaaatcaacgctgtaatgaaagatgctgctacagaatcttacggatacactgaagacgaaatcgtatcatgcgatatcatcggaagcagcttcggatcattattcgatgcaactcaaacaagagttatggaagttaacggagaacaattagttaaagttgcttcttggtacgacaacgaaatgtcatacactaaccaattaatcagaactttaggatacttcgctaacttaaagtaatctaaaccctaattaaacataaaatgcgcaaatttatgttaaagtaaataagtctggttttgtagtataaggctataaagccagactattttaaaattatctataaaaataattttttgaggtgaatgtaaatgaatttcaacaagaaaacaatcgaagatatcgatgtagcaggaaaaaaagtattagtaagatgtgactttaatgtaccattaaaagatggtgttataactgatgaaaatagattaaacggagctcttccaacaatcaaatacttagttgaaaaaggtgcaaaagttatcctttgctctcacttaggaaaagatgcttctaaatcattagctcctgtagctgtaagattaagcgaaatgcttggaaaagaagtagtttttgctagagatgaagaagttgttggagaaaatgctaaaaaagctgttgctgatatgaaagacggagacgttgtattattagaaaacactagatgcagaaaagaagaaactaagaacatagctgaattctctaaagaattagcttcattagcagatgtatttgtaaatgatgcatttggtacagctcacagagctcactgttcaacagttggtgttactgaatacttagatacagctgtatgtggatacttaatccaaaaagaattaaaattcttaggaaatgctgttgaaactccagaaagaccattcgttgctatattaggtggagctaaagtttctgataagattgctgttatcaacaacttattagacaaagttaacactataatcattggtggtggaatggcttatacattcttaaaagctcaaggatatgaaatcggaacttcattagttgaagaagatagacttgactatgcaaaagaaatggttgctaaagctgaagctaagggtgttaaattcttattaccagtagaccacagagtagctgctgaatttaaagatgtagctgctacagttactgaagaccaaaacattcctgctggaaacatgggattagatatcggacctaagacagaagctatatacgctgatgctattaaagatgctaagactgttatctggaatggaccaatgggagtattcgaattcgaaaactacaataagggtacaattgcagtagctaaggctatggcagatgcagatgctacaactataatcggtggtggagatagtgctgctgctgttaacatattaggatttggagataagatgactcacatctcaactggtggtggagcttctttagaattcttagaaggtaaagtattaccaggaatagctgcattaaacgactaattataaattagatatattaaaattaaatatcacaattaaatagtgtatgactattattgaagtttacagctaatatagtagaaagtaattacaaatatattttataattgaatattaatacagctttaagaatgttcgacgggactttgtagagctttaggccaaaagctttaccttgaaatgtataattacttaattaataaatataacttaataccatggtctatgaaaatagcagtaaataatgaacttaagaaaatctgatcaattttcttaagttcataacattaaattgacaattatcacatgtaaattgtaatatatactatttgattttgagtttaattttcagaattgtaaataaattttaatattatatgaggtggataaaatgagaaaagcaattatcgctggaaactggaaaatgaataaaactgttgatgaagcagttaaaatgatagaagaattaaaagcattagttaaggatgctacttgtgatgtagtagtatgtcctacatttgtatgtttagatgctgttaaaaaagctgtagctggatcaaacataaaagttgctgctcaaaacatgcactttgaagaaagtggagcatttacaggagaagttgctccaggaatgcttgaagctatgggaattgattatgttgttttaggacatagtgaaagaagagaatacttcaacgaaactgatgaagctttaaacaagaaggttaaagctgcatttgctcacaacataactccaatcctttgttgtggtgaaactttagaacaaagagaaaacggaacaactaatgcagttgttggagctcaaataaaagctgatttagaaggtttatcaaaagacttagcagaaaaagttgttatagcttacgaaccaatctgggctattggaactggtaagactgctacagacgaacaagcaaacgaaactatcaaagcaataagaggaatcgtagctgaaatgttcggaagcgaagttgctgataaagtaagaatccaatacggtggatctgttaaaccaggtacaatcaaagctcaaatggaacaatcagatattgacggagctttagttggtggagctagtttagctgctgcagactttgctgcaatagttaattactaagattagtgaaaaatacctatgttctacataggtattttttattatgttaatatatttttacaataaaaaataataaagtatataaataattaagtttaaaaatatgtatagaagaattgttttatctacataaaaaattgcagatgaattaaaataatagcagaagattaaaggaataagagtattttgtaaaagaatacatcaatctttcgaaaagctataataagttgcaataaagataaaaaaataatataattaaatggttcaaatgtagaaaaatttaattatgaatatatattataattttaaataagaaaacttggagggataggactatgtcaaagaaaccagttatgttaatgatattagatggttttggattagcaccaaaatcagaaggaaatgctgtaagtttagcaaataaaccaaacttcgacagattaacagctaattacccaacatcacaattacaagcaagtggtatgcaagttggattaccagaaggacaaatgggtaactcagaagttggacatttaaatataggatcaggaagaattgtatatcaagaattaacaagaataactaaagctatcagtgatggagacttctttgaaaatgaatctattaaattagctatggaaaatgctaaaaaaactggatctgcattacacttaatgggtctattatctgatggtggagttcattcacatatagatcacctaaaaggtcttttagaatttgctaaaaaagaaggcgttcaaaatgtatttgttcatgcatttatggatggtagagacgttccaccttcatcaggaaaagaattcatagaaaaatgcgaagctatgatggctgaagttggtgtaggaaaaatagctactataagtggtagatactatgctatggatagagataatagatgggaaagagttgaacttgcttataacgcattagttttaggtaaaggtgaaacagctacaagtgcagtagaagctattgaaaaatcataccatgataacaagacagatgagttcgtattaccaacagttataactgaaaatggtgcaccattaactaatattaaaaacggagactcagttgtattctttaactttagaccagacagagctagagaaataactagagctataaatgataaagaatttgctggatttaagagagaaacattagatttagtatttgtaacaatgactcaatatgataagacattagaaggggttaatgttgcatatacaccacaaacactagtaaatactcttggagaatatgtaagtagcaagggattaaatcaattaagaattgctgaaactgaaaagtatgctcacgttacattcttcttcaatggtggtgttgaaaaagaaaatccaggtgaagatagaaaggttataccttcaccaaaggttgcaacttatgatttaaaaccagaaatgagtgcttatgaagtaactgaagaattattagctagattagacagcgataaatatgacatgatcatattaaactttgctaatccagatatggttggtcatactggtgttgttgaagcagctgttaaggcaatagaggctgttgatgaatgcttaggaaatgtagttaataaagtattagaaaaagatggaacagtatttattactgctgaccatggtaatgcggaaactgaaatagatttttcaacaggaaatccatttacagctcatactactaatccagttccatttgtatgggtatctaaccacacagaaggaaagacaataaaagatggtaagcttgctgatatagctccaacaatgttaaatgttttaggtcttgaagtaccagcagaaatgactggagaaaacttaataataaataaataataatttttagtatatagtaaaaggggctgtatcaaaacaattttgatactagccgataaaaaaagagaattcataaatttgaattctcttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttgtttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaagagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaatgaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatatatacatgaataaaatttacgtttataagaataggctgtatcaaattgaatttaaaaaatttcaatttgatacagccccttttcttgttattttgaatatttctgtagtatgaacaatatattaataaaaaagacttatctagggttggtttatatgaaaaaaattttgggtattctgttgattttgacgaacatacagaattattatttaaacaggcaacatatcttggacaaggaaataatggaatagtatacgagctacctgataataaagcaataaaaatttttttatctaaaaaggtatgcaatgatgaaggtggaatattattaagaaccaatgggtctaaatattttccgaaattatataaaaaaggaacatactatatagtaagggataaagtagaaggaatagagatggataagtatataaaaacttatggcttaaatagaaatttagtagaaaaaatatataagctattagtagaatttaaaaaactaaagtttaaaaaattagatataagatgtaaggatattcttgtatctgataaggaaactctaatgataattgatcctaagaaagcatatgaaagaaaagttgattatccaaggcatttaatgaaaggattaaaaagacttggagttctagaagagttcttaagtgaaataaatagaattaacagtaagaaggctcgagaatgggaacaaaagtttagtgaatactgcgaagcagagaatcatttgaagtttatggaataaaatacaccatttattcgtttgaataaatggtgtattttttatatagtacataaggtatttattgtaaagaaccatctgcagttacaaaataatataaaatgggaaatgaattttgaatatttaattttaaaattacaaagaatactaaagtagattaaaaagctgagaagcttttatatattaacttaatatataaaatacttagtaaacaaggagggtaaaacaaaatgaaagattatttagaaattgtagatgtggtagcaagacaaattatagactcaaggtgttttccaactgtagaagttgaaatatatcttgaagatggtactatgggaagggctgcagttccatcaggagcatcaactgggatgtatgaagcagttgaattaagagatggagataaaggtgtatatcaaggaaaaggtgttttaaaagctgtagaaaatgtaaatgatactattgcagaagaattaataggatgtaatgtatttgatcaaacatatattgataaaatgcttattgaattagatggaacaaacaataaaggtaaattaggtgcaaatgcaattttaggtgtatctttagctgttgcaaatgcagctgcaaatgcattaggtattcctttatatagatatattggaggagtaaacgcaaaggttttaccagtgcctatgatgaatatattaaatggtggatctcatgctgataattcagttgatttacaagaatttatgattatgcctgcaggagcgggtacttttagtgatgctttaagaatgtgtgctgaagtttatcatacattaaagaaaattttaaatgataagggttatgctacaggtataggtgatgaaggtggatttgcaccaaatttaaagagcaatgctgaagctttagatgtaattatcgaagcaataggaaaagcaggttacaaagctggtgaagaaattttcatagcaattgatgctgcttcatcagaatattataaagatggaaaatatgttttagaacatgaaggaagaactttatcaagtgcagagatggttgatttctttgaagaatgggttaataaatatccaataatctcaattgaagatggtatggcagaagaagattgggatggatggaaattaatgactgaaagattaggaaaaaaagttcagttagttggtgatgacttatttgttacaaatactgaaagacttgaaaaaggaattcaacttggagttgcaaattctatccttataaaactaaatcaaattggtactttaacagaaacattaaatgcaatagaaatggctaatagagctggatatacagcagttgtttctcatagaagtggtgaaacagaagatactactattgcagatttagttgtagctacaaatgcaggtcaaattaaaacaggtgctccagcaagatctgaaagagtagctaaatataatcaattaataagaatagaagaagaattagatgatgttgctgaatatagaggtaaaaaggcattctttaacattaaatagttaaagtaaaaaaatataagtgtgacagggaactgtatttgattgatgttaattaggcaattgatacagttccttttgaattttattatttaaataggaagaataaatcatagaatgattataattaaataagaaattatggacataaatttcgttttataaataattaagtagatatgggtggagctatttgatataatttaggtaaatttgttttattgtagaatcttaatattagaaagcattctttataaaattgcaaaaaatattatttttaaaatttacataattatatttgcattttgatagagaaatatttttgagaaaactatgaacaaatgataaatctaataattatttaaaagaaagaggatattgtatgaattactatttggatgtattaaagaaatatgcaactttttctgggagagcaagaagaaaagagtattggatgtttgttcttattaatgctatagtggttatggctatttcgctaattgagtatgcagcaggaactaatggaataataggttatatttatggattagcattaattataccaatgattgcagttactgttagaagacttcatgatattggcaagagtggattttggtattttatatgtttaattcctttgatagggtcaatatggctactagtgttgttatgtacagacagtcaaccggggcaaaatcaatttggtgctaatttgaaggggtataataattaaaacatagctataatttagttatttatgagtgaaagtattatattaaatataaattaacaaaattattttaaaatgtaaaaaatatgatataatataagtaagctcagatgtaattttttactacagagaagttgtaatagaacagtaaatgtgatattatttagaatgtacgttattgattattataggaggtgttacctatgcaaaatatattaatggtcttagaagttttgttaggactaggagtaattattacaatttacatgcaaccaagtaaagcagatgctttaagtgggttaattcagggagctactaaggacacattcttttcaaagaacaaggcaagaactaaggaagttgttcttgtaagattaacagttttattttcaatattatttgctgttaatacagttttagtaaatttaataaaatagtaatctgagctacttaaatataggtagctttttttattatatctagaaaatcaaatcttaaaaaatcatttcatccaatatatgtgttccaattaatattaacaatgccttaaaaatccgtatgagatttattgaacttatatgtagaacatttattagaatagttataaataaaattttagaataatcataagatatgctttatttaaaattgtaatccaatacaagaatgttaaaggataattatgaatatatctataaagtaaagcaagcctaatcttttatactaaaaacctaaaaaaatataaggggtgataggtatgaatttattatatcttccaattttaacaggtattgtttctttagttgttgttgtttttattgcaaacagtattattaaaagggatcctggaagcgatagaatgagggaaatatcaggttacattgaagagggtgctatggcgtttcttaaaaaggaatattgttatttagcagtatttattattatagtagctttatctatatttatattcttgaacataaatactgcaatagcatttatagtaggagcactattctcaataacagcaggatttgttggaatgagaattgctgtaaaatctaatgttagaactgcacaagcagctaaacatgggataaaggaagcactatcagttgctttttctggtggatctgttatgggtttatgtgtagtaggattagggttaataggattgggttttttctcaatagtttttgatttaaatgctgaatatattacaggatttggacttggtgcatcttcaatagcattatttgcaagagttggcggtggtatatataccaaggcagcagatgtaggagcagaccttgtaggtaaagttgaggcagggataccagaagatgatccaagaaatccagcggttattgctgataatgttggagataatgttggggatgttgcaggtatgggcgcagacttatttgaatcatatgttggctcaataatatcagcaataactcttggtacaactttagttagtagttttggtaagaatatagtgttatttccattattgttatcagctgtgggagtattgtcatcattaataggcataatatacgttaagttatataaaggagataatccacagaaagcattaaatggaggcagtgcaatatctggtgcaatagttatagtagtaggatttattctttgtaaatatatgattggtgatatgagaatatttattccaatagtagcaggtttgatagttggtttattgattggtaaaattacagaaatatatacatcagcagattataaaagtgttaaattaattgcagatgaatcaaaaacagggccagctacaaatattatagctggattatcagtaggaatgaaatcaacagttgctcctattttattaattgttataggaataatagtttcatattttgctattggtggatcttcaaattcagaacttgggttatatggaatagcattagcagcagttggaatgcttgcaacaacagcaacaacaatagctgttgatgcatatggaccaatatctgataatgcaggtggtatagcagaaatgtgcgaattagatgaaagcgtaagagaaattacagacaaacttgattcagttggtaacactacagcggcaataggcaagggatttgcaataggatcagcggcacttacagcattagctttgtttgcatcatattctcaggctgtaaatttaaacagtattaaccttctaaatccactaacattagttggagtattacttggtggcatgttaccatttttatttggagcattaacaatgcaatctgtaggtaaagcagcaacacagatggtagaagaagttagaaggcagtttaaggagaagaagggaatattagaaggaactgaaaaacctgattattctaagtgtgtagaaatatctactaaagcagcattaagagaaatgattttacctggaattcttgcaatattagtaccgttaggtacaggattattacttggaacagaggcattagcaggattaataggtggtggagtactttcaggggtattacttgccataatgatggcaaatgcaggtggtgcatgggataatgcaaagaaatatattgaaacaggtgtaaatggaggtaaaggaagttttgctcataaagctggtgttgttggcgatacagtaggcgatccgtttaaagatacatctggtccatcaatgaatattttaattaaattaatgacaatagtatcagttgtttttgcaccagtaatagcacaatatggaggtttattattaagtttatttaagtaaaattaattattcatcattaaagaagagattattttaattatttttattagaataatctctttaagagtattaaagtgtcagtagaatatttaggaatataatataataaaaataaaaaaatgaaaatttttcaaaatagtgttgacagatatgtaaaagaattgtatgataatatcatagtaattcgctaagaatacttgatttaaaagtgaatatgtttttatcaagaaagacggagggactggccctgtgatgtctggcaacctggaggatatatcatatatatattgtttaaggtgctaattcctgcagattttatatctgagagataagaagagttttagttcaatagtgttatttatcactgctttcttatcttgaaagcagtttttttgtatataaaattgtaaaaatatattcttgtgttatattcatataaaaattggggaattgtttaatttaaatcatagtaaatttatcatatatctatggttttgaaatataaaaaatataaataaaattgggggcaaaaattatgagtagagaagaaagaaatttaaaatttgaaacattacaattacatgttggacaagaaagtccagatccagcaacagatgcaagagctgtaccaatatatcagacaacatcttatgtatttagaaattgtgaacatgctgcagcaagatttggattatcagatccaggaaatatatatggaagattaacaaattcaacacaggatgttttagaaaaaagagtagctgcattagaaggtggagttgcaggtcttgctgtagcttcaggagcagcagctataacatatgcaattgaaaatataacaagagcaggagatcatatagtagcggctaaaacaatatatggaggttcctataatcttttagcacatactttagctaactatggtgttacaacaacatttgttgatccggaaaatttatcaaattttgaaaatgctataaaagaaaatacaaaagctgtatatatagaatcactaggaaatcctaattctaatattatagatgtagaagcgttagcagaaattgcacataagcataagattcctttaatagttgataatacatttggaacaccttatctttttagaccaattgaacatggggcagatatagttgttcattcagctactaagtttataggtggtcatggaacatcattaggaggaataattgtagactctggtaaatttgattggataggaagtggtaagttcccacaattaacagaagcagatccaagttatcatggaataaaatttgctgaagcagttggtgaagcagcatatgtgacaagaataagagcaatactacttagggatacaggtgcagcaataagtccatttaatgcatttatattattgcaaggattagaaacactgtcattaagacttgaaagacatattgagaattcattaaaagtagtagagttcttaaaaaatcatcctaaagttgaaagagttaatcacccagcattacaagatagtccagattatgaattatataaaaagtattttccaaaaggtgcaggttcaatctttacatttgaaattaaaggcggagcaaaggaagctcaagaatttatagatagattagaaatattctcattacttgcaaatgtagcagatgttaagtcacttgtaatacatccagcaactacaacacattcacaattgacacaagaagaattattagaccagggaattaagccaaatacaataagattatcaattggaacagagcatattgatgatattatttacgacttatcacaggcatttgaagggtaaattatatatttatagtatttaagtaataatgaaaagctgagcataaaaagggtgcttggctttttatattttaagtctaatctgttgataataaatattgtattatttttattaaagtataagaaaatatggaattataaatatttaccttattttgatgaatatatttatatatgaattaaataaaagcagaaatatgtgtcaatactaataatattatgatataaaatctatattgtgcattattaatgtggtagtatataggtataaagtaatataatatagtatattgtataatggaggaaattattatgggaataaaacagacattagtaagttttatgaaagaacctgcatatagccctatggcacttgaagatttagttgctgtatttgatataaaacctaatgagtatagtgcatttaaaaaaacattaagagttatggaacgtgaaggtctcatcatgagaactaaaaaggatagatttataattgctgatggtaataataatcatattgaaacaaaagaaaatttagttataggaacattacaagctcatgcaaaaggatttggatttttaattcctgaagatgaaaatgaaaaggatgtatttttaccaagtaattgtatgaatggagctattaatggagataaaatcgctgttaaggttacaagagaagatacaaatacaaaaaaaagagaaggcgaagtcgtagaaatacttgaaagaaacacaacaactgtagttggaatttatgaagattctaaaagttttggatttgttatatcagaagatacaagaatatcaagagatatttatattcctaaaagagatagaaatggtgcacaagatggtgatgttgttacggtaaaaataacaaaatggccagaaggaaatagaaaaccagagggtgttgtaacagaagtattaggaagaaaaggtgatagaggaatagacatccttatagtaattaaaaaattaggacttcctgaagaatttaatagtaaagtattaaaatatgcagagggtatttccgaggaaattgacgaaagtgaatataaaggtagaagagatttaagagatgtaagaatggtaacaatagatggtgaagacgctaaggatttagatgatgctgtatctatagaaaaactacctaatggaaattataaattaggagttcacattgcggacgtttctcactatgtacgtgaaaataatcctcttgataaagaagcatttaaaagagcaacttcagtatatttaatagacagggttattccaatgcttcctagaaaattatctaatggaatatgttcattaaatcctaaagttgatagactaactttatcatgtataatggaaatagatcataaaggaaaagttgttaatcatgaaatagttgaatctgtaataagaactaatgaaagaatgacatatacagatgtaactaagattttagaagataatgatgaagagttaattaagagatacgattatcttgttgatgactttaaaacaatgaaagagctttgtaaaatattaagagcaaagagaaccaaaaggggagctattgattttgaaatagctgaagctaaaataatattaaatgaacttggaaaaccaatagaaataaagccttatgatagagctatatctaatagaatgattgaagaatttatgcttgtagcaaatgaaactgtggcagagcatatgttctggacacatttaccttttgtatatagaattcatgaaaatcctgatgatgaaaaattaactaagttcaaagaatttattcataatttaggatacaatattaattggactgaagaaataagaccgaagacacttcaagatataatagaaaaggtaaagggtaagagtgaagaaacagtagtaaatactttattattacgttcaatgatgcaagcaaggtatgcaccagaatgtactggtcactttggattagcagcacaatattattgtcactttacttcgccaataagaagatatcctgatttacaaattcacagaataattaaagaatatcttcatggaaaaatagatgaaaagagagaaaataaattaaagaatattgttggtcactcagcaaaacagtcatcagaaatggaaagaaaagctcaagatgcagaaagagaagttgatgatttaaagaaagctgaatatatgcaggatagaattggagaagaatttgaaggtgttatttcttctgtaacatcatttggagtctttgtggaacttccaagtacaatagaaggtttagttcatattacagatttagatgatgattactatatttatgaagaagatcatttaagattaatcggtgagagaactaagaaaatctataaacttggagataaagtacttgtagagtgtgttcatgttgatatgccaaataaagaaatattctttaagattattgaagaaccaaatgaagaagaagtttcagtagaagaacctaaaaataatgagagcgaaattgaaattaaatgaaagagaatggtttatgatagaaaatctttaagaagcaaaaaatagtcataaataatgatatgaataatattaagtgaatctcaaagtaggttcacttgatatttatatacagataaatatttaaaagtattataatattaatttttttaggaaaagtgcagcattgatttaaattaatgagtataatataatttaaattagaaaatatgaccatagtaggtgattagaatggtaagaaaaaagaatcaaaattctttagcggaaaatagaaaagcaagacatgattattttgtagaagaagcaatggaagcaggattagtattagttggaacagaagttaagtctataagaaaaggacgagttaacttgaaagactgttatgcagatatatataatggtgagatttatataaaaaatatgcatatttcaccatacgaacagggaaatatattcaatgttgatccgttaagagaaagaaagcttcttctccataaagatgaaataagaagattggatggattagtttcaagagacggatatacattaattccattatcattatatctaaaagaaggaaaagtaaaagtggctcttggtgtctgcaaaggtaagaaaaattatgataaaagagatgccatgattgaaaaagctcaaaaaagagatattgatagagctatgaaagaaagaagcagatattagaattaagattcacttatatactataaagtataaaagtgaatttttttcataaagtgttgacaacttaaaaatttaggcttataattcatagcataaactaaattaaataatttgatgtcttatcaagagtggcggagggactggccctgtgaagcccagcaaccgacggattggttcatttaccaatggagtacggtgctaattcctgcagctttttttttagaagctggtagatgagagggtaaatcacgtagtgttttcgtgcgctagagttttattctctagcgcttttttgtttagttatcgcgattactaaaacaaattttaaaaggaggaagagaattttgctaaatattaagaaaacaacagaagatgaagtattattaaaagaatctgctgtgtcagcatatgcggaagcagccgttgaaataaaaaatgtagtaaaaagttttggaaatgtacaggttataaaagatgtgtcatttactataaatcaaggggagatttatggaataataggacacagtggtgcaggtaaatctacgttacttagatgtataaatgggcttgaatcttataatggaggatctgtaaatgtaatggggaaagaagtttctgcattaaatgatggagagcttagagtattcagaaaagaattaggcatgatttttcaaaattttaatttattgcagagaaaaaatgttttcgataatgtagcacttcctcttgaagtttggggttatgataaaaacacaattaaagaaaaggtatcagaattacttaaattagttggattagaagacaaaattcttagaaagccatctcaattaagtggtggtcagaaacagagggtagcaatagcaagagcattagcattagatccaaagatactgctttgcgatgaagcaacatcagcattggatccaaaaacaacgaaggatattctacaacttcttttaaagataaataaagaacttggaataacaataataattgttacacatcagatggaagttattaaagaagtatgtgaaagagttgcattattagatggaggagaaataaaggctgagggaaaagcagaagatttattcttaaaaccaggcaaatcattaaagaaattcttaggtgaagaagatgaagaaaatctaccagatacaggaataaatataaaattgtatttcccaagtaattcttcagaaaatgcacttataacaagaatgtcacgagaacttgagatagacttttcaatagtttggggtaaattagaaaagtttagggaccaagtattaggggattagtaataaatataaatgaagaagataaagaaaaggtcttaaagtaccttgaagataaagatattttactggaggtgcttagataatgaatgaaattatagttaaagcgttaatagaaacattaaaaatggtttttgtatcaactacattctctgttattttaggatttataccagctataatactaacagtaacagcaagggatgggcttaaaccaaatagaataatatacaacattttagattttatagttaatacattaagaagttttccttttgtaatattaatggttatagtagtacctttaacaaaattaatagcaggaaagtcaataggaactgaagctgctatggtaccacttacaattgcagcagcaccttttgttgctaggattatagaatcttccttaagagaagtggataaaggtgttatagaagctgctaagtcatttggagcatcaaatatgcagattattttcaaagttatgcttaaagaagcaataccttcaatagtttcaggtataacattaaccataataagtattgttggatactcagcaatggcaggagctattggtggaggggacttggtgatgttgctataagatatggatatcaaagatttcaaacagatatgatggtggcaacttgtataatacttatagttatagtacaggcactacaaattttggggaattatttttataataaattatctaaataatatacaagatacgatggatagacctttagtatttacaaaaaggttcattcccatcaataaaataaatcagagtaagtttataaagtaacttgatattaaaattattaaaaatagtataaatatatatgatagcagagaactaataaatagatttaactgctaatcaaaaagaaagtggggataaataatgaaaaagaaatcaatattatcagtagttttagcaggagtacttgcaattggattaataggatgtggggaactggaagtaacggttcaggagcagattcgaaagatgataaagtaataaaaattggtgtaacaccaaagccacataaagaaattgtagatgcagcagttcctttattagaaaaggaaggctataaagtagaaatcactgaatttaatgattatgttcagccaaatacagcagttgaagaaggatctttagatgtaaatttctttcaacacacaccatatttaaatgaacaagtacaatctagaggattacatttaaaatcagttgcagcgattcacttagaaccaatgggattatattctaagaagattacatctttagatgaattaaaggatggatctacaatagcggttccaaatgatccatcaaatgaagctagagcattaaaattactagcagctaatggattaataaaaattaaagatggagaattagttacaccagcagatataacagaaaatccaaagaatttacaatttagtgagttagaagcggcagcagttccaagagcagtggatgatgtagatgcagctgtaattaatggtaattatgctattgaggcaggatttgatccaacagcaaatgcaattgtcaaagaagataaagattctgaagcagctaagccttatgctaacattgttgttgtaaaagaaggaaatgaaaatcttgaaaaaattcaagctttaataaaagcattaacttctgatgaagttagagattttattaataaagaatataatggagcagttattccagtattctaatattaacaatttagacatatattgaaattctacaaaatattaaataggagatatctagttataaagttgctagatatctcctattttggttaattgtcaattgaaatatgtgtggtatactttatataataaaaactttataaggattaatattatctaattttttattgtttaagattagtattaaagaaaaaggggaaggttaaaaatgaaaatatcagaagtgaaggtgaagcttttagggagtgatgttttaagtatagtaaatgaatttgtaaaagtagacggattgaatttaaaaaatattattataaatgatggaattgaaattgaaggtacttttaaaaaaggattcagtgtagatttttcagtaaaagcagaaatacttggttgtgaaaataacaaaattaaagctagactctcaaaagtaaagctttttaatttggggatttttagattgataagaagctttgtattgaaaaaactatctaaagaattcgaggaatttggtattgctagtaataaagatattgctattattgatataaaaaagatacttaaggatattccatatgttgatttaaatattaatgaaatatatacaaagagttcagaagtttgggtagaagcagataatatagaggtatctattgcaggaagccttattaaggaaaaaatttctgaaacaattaatgaaaataaacaagaagaagagatatatgaattagaaaatattaataaaattaaagataattattctgcaggtagaaatattttagcacaaaagcttccagataatattaaagaatacaaagattatttatttatattacctgatttggtttcgcttatttatcgattgctaaaagataagagagttcctataaaaacaaaattagtaatgtcagcagcagtagcatatgtaatgttcccatcagatttaattcctaataatattccatttatagggttatagatgatattggtgtaatattttttgctttaaatagggtggtaagtgatgtgccattgagtttaatagttgaaaattgggaaggaagcaatgatataataattgtaatgaaaaatggactagaatatttaactaactttacagctgctacaaatgtagaaaaattatatgaatttgtagaagaattgtctacattataataaatagaaaaactttatattaatgaaaggatttataatatggctaaaaaagtatatgcaatacaatatggttttgactcaaaaaacaatcaaaaaattgagaataaaatagtaggaacatgggcggaatgtttatcatatgtaaaaggggtaaaaggagcaaaatataaaagctttgaaaatatgtcagatgctgagggatatttaaatgaaggaaataggatgttaaaaaaagtagataataattatcctaaagattgccttcatgcatatgtagatggaagttatagtgtttctgatggaagatatgcttatggagtagtatgtgttaaaaataatattgtagaatatgttgaaaatggcgctgaaaaagatacatcagaaaaaaatataagacaaattgcaggagaacttaagggcgctttaagagctgcactttatgctttagataaaggtgaaaaaaaagtggtgatttttcatgactatgaaggaattgctaaccatgctacaggtgcatggtcaagaaatgaacaatcatcagttgaatatcataggcagatgcaggaattaatgaaaaatggtttagaaataatttttgtaaaggtagatagtcatacaggagatttatttaatgaacttgtagatgaaaaatgcaaggagcctttaggaatacaatcagataagatagtagaaaagcatcttatatgtgataaaatttatgtaaccaatacaaatataaaagaagcgatacttactcttgcaccaaattctggcgataatatagttgtaatggacactaatatggaccttaatggaatttcaaatcattcggtttgcacaaatgtatctaaagaagtagatgcggaatctgatgatgaatcaagatactttgaaattacagaattatataaaattaatcctgttcaggcaaagaaaaagatttctaaaatgctaagcaaagataaagagaaatttattttatatcttttagaattaaaataaattttaatatttagtgaataacttttttaataatacataacctacttttagaacatttatctaaaataaaataaaaagaggtgttttgtagtgtgtaagtttattaaaggaatggttatgggagcagtagttggagcagcatttgagatgatgatgtttccacaaatggatagaagagctcaaagaagcatgagaagaatgggagacagaatgagacatatggcaggttgtacatatgatggagtatgtgactggataaaataagtacatctgtgttaaaaaatactggaatttcaaatttcagtattttttttatttttctttaattaaatagttgataaagtaaataaaaatagtaaaaaaaagattatgaattggataataaaattaaattatataaaatatagaaaaaagttcagaaattcatgcagttttttataaatttatgttataattaaggaaaaatacattaacataattaaataatttgttgaatagagaaggattaaaaaaatggaaattctatcattgggagaaaaaattaaaagaagaagaaaacaacttaatatgaccttaaaggatttagctaaggacagaataactccagggcagataagtttagttgaatcaggacgttccaatccatcagtagatttacttgagtatttagcatctactctaaatacaacagttgagtatcttatggagtctgaagaaagtcaggcagaaaaaattagcatttattatgaacaagtaggggaatcttgtatattaaatggagattatgaaaaaggacagaggtatatcgacaatgctttatattattccgagaaatataatctagaatatagaaaagctaaaatattttttattactgctgaatcatatatgctcagaagagattttcccatggctcaaaagttttttctatcatcaaatgtaatttttgttaagaacaataattatgaagaaataataaaaacatttttaaatttagctgatatagcactagaacttaaagcatatcattctgcaagtagttatttaaaacaagcagaaatggtgtataatgataatgaggttgtagatgattttctaattggtgagattcattacaatatgtcaagaacatattttgacgtagaagatttagagttagcattaaaatatgcatataaggcgaaagaaaaatttgaacagatatacaatgatgattattatgcaagaaatttattttcacttgcagaagattacaataaaaaaggtgatatattaaatgctcttaaatattcaaagaagacactacaggtttataaaaaaatagagcataatagaaacatagtgaatattgaacgtaatctaggaagaattttttatgaattagatgaattagatgagtcatttaaacattatgaggtgtctaaaaatgtgagcatacaaaatcgcattggttgtactaatgatacgttaatagatatatgcaaaaattatttgaaattaaagaatactaaaaagtgtgaaaagattttaaatgatattgaaaatagtcttacagaaaaagatgtagacagaaaaatacaatgtcagttaataagatatactatgtttaatatagatgaaagtgtagaggatgcagaaaatgtgttaaagaatacttatacttttgcaaaagaaaatggaagattagctaaagcgggggaattagctatgagggttggtaaatatttcatggataagaagaatgaacaagaagctgcatattatctaaatgaaggaatagagttatttagacaagctgaagaagtgaaaactaataaataaaaatgggtgatatactatggaaatactatctactggtgaaaaaataaagagggctagaatatttaaaggaattactttgaaagagctatgtgaagacaaaatttcaatagcaaaaatgagctgtattgaaaatggaaaagccaaagctgacagagaattgcttgaatatatagcaaaaaaaatagaaatagatttagattatcttgttgaagatgtttatgaacagataatcaataatttggctttaattaaaaaaaatatttcatctgacgatgatgttgaagaaaaacttaaagataatttagcttatgcagctcaatatggatattacaatttagcatttgaacttatacacattttgtttacatattatattgaagaaaataaaattgaaaatattcaattgatagtttctgaatactatgatttgtatcaaagagataacacagaggaaaacactataatatattttaaagatatggcaagatatcttttgtataatgaagagtatattgaagcaatatcttattatggaaagcttcgagaaatgatgcttcaaaaagaagactatgataaagcagaatattgtgttatagcatataatgaggctatatgttaccaaaatattggtaaatttaaagaagcttatgatattttaagcagtatcatagaatatgttgaagagttaaaatcatatgaagtaaaaggaaaaatatatcatatatatacaaatgtatgtataaaattaagaaaagatggcgttgaagaatataagaagagggcttatcaatatgaaaagcataatcttatttcgttagctagatcatatggggattatggaaaatattattttgcagtaggcgaaaaagaaaaagcaataacagaaattgaatcaggaataaatacatttccaaaggataataaagagaagtatgttgagtttttaaattcatgtatagagatattaattgcaaataatgaatatattgtggcatatgaaataacagaagatgcattaaatatggcaataattacagacaatataagattaatagaaagatcttactatttaaaaggaacaatacttcaaaaactggacaagtatgaagaagctgagaaatatatgaatttatctttagattcactatttaaatttgggtcaagagaagaaagaaaaaatagatatattgatatggcaaatttgtattataaacttggtgcaacattagattcattaaaatactttaatcttgcactaactgtagataaaaaaatataaaaaaacaaagagtcagaataaaatctaaaatggatcctgtgtcaaggacactataaaaaagtgttatgaagctaataaaagatgatttctatattgtttaggagtcatcttttttagattccactgatatctgtaattattataatagtcgatgtagtcatcaatcatatcaataagttcttcaagtgtattacatgattgaaagtctatttcatctttcatatgcccgaagaaggattcttgaggcgcattgtcccaacagttgccacgacgagacattgattgaccaagattattatcctttagaagtttttggaattttggactagtataatggaatccttgatctgaatgaacaaatgcactttcatgtaagtcatctttatggtgcgttattaatttatttatagtagttatagcaatatcaagttttatagaatctgaaacatgataagctagaatatcgttgctactaccatctttgatggtagacaaataagccatatgattatttccatatggcaagtatgtaatatccgtcaataatacctttcccggcactccttgcttaaaattacgttctaataagtttggaactactgtatgttctttggttgcttttgccattcggcggtacgggttggcttttctaataggacatttaatattatattttctcataatacgttgaattttctttctactataaattatagaaagctcattttctaaaaccatttttatagaacgggatcctttgctataacctttgtaattataagccataagaatattgtctctagcttccaaatctttattttccattaatatttgattatcaagtgtatttagataattataatatcccgagcgtgaaacatttaaaagatcacagaaatatgaaaccatatttttatagctattattagtgatagtttcatatattaacttaaatatctccttaccttctagatttaagctgctgtttaccagcctcctttctgtcacgtctaatttttttaacagttctaattgctcctctaataacttaattttagcttcttgtttttgaataatatcatctttagataattgcttttcacttggtcgtccagagttttctttcctagtatctcttaatcctacaataccctcttttctataagatcttatccatctagctgccgcttgttcgtatcttctttgtccaaggatttgtgtatcaaaaccagcgtcattaaaaataattttaggtgtttttccttttaaatattcttctataaataatcgcttaaactcgtcagagtaagttatagatttttcacttactttaactacataaggattttcattcagtaattcaatagtttctttatcaaatgttatcttactcatgtttttcctccaatatagatattattattatacaaaaaagtacctataaacgagacactttttttcaaagtgtcctgttcataggtaccattttaatctgactctttgtttttttaatgaaacacttatatttaataatttatttatcatgatttgatgtatcagttgtatttttactgcttactacagttttaaagatatcaataaaatctttaacatccacttttttatcattattaggagtattattaggagtagtggaatttttcttaatgaatgattttattacttctgaaatatcaattccagttaaatcattaattacttcaaaacctgaacctgcaacatcggtgacagtttttgatattttagatgtactgtttccattactaccagtatcgattactgtgattttatcaatattagacataggtttagaaatttcactcataatttcaggtagtttagaaataatcatttcaacaatagcagcttccccatacttagccatcgcatcagcaagtctatcttttgcttcagcttcagctattcctttagcttttatagagagcgcttcggcttctccacgtgctttaattgcttcagcatcagcaagtgcttcaattttttttgcttcagcttttgcaaatgcctcaattcttattttttcagcttcggcctcagcttcttttatagattgtactttttgagcttcagcataaatttcaattttacgtttttctgcatttgctggtttttcaacttttgcaacaagttctttttcaactcttatagcttcttgttcggcaagaatagctttttgcttttctacttcagattgtttttctatttcttttaagctataggctatatcagcttcagctttagctttatcttgttcagctctatattgttcaactttgattcttttatctctttcggcagaagctacttcagcatcagcggctaattttactatttgaccttctcgtacagcttcagctgtctttatatcagtatctctttttcgttcagcttcagctacttcggcatcagcctttgattgtgcaacttgtggcctagctctattttctagatatccgccttgcgttgaaatctgaagaatagagtatgaaataagctgtaatcccatttcactaagttcacgctttatatcttcttctacttttttttcaaaagcataacgatcgttgtttatctgttctacagtcattgtagacacaattcctcttaaacgtccttctaaaacaggctctaccatagcacgtattacgtcagtagtatttttggcattcccattacaaaattgttcaacggctttatagatactatcaattttattttctacttttactactgcggtaccagtaacatctacaaatataccttgttgagaaggagcttctttaacgtcagtagtcattgaaatattttctaaggatactatacatgacgtttcaaaaaaaggtattataaagccaccctttccagtaagaactcttttctttaaaccagtaataaccatagctttatctgcaggaacttttcgccagaataaaattacagcgataattaatattagaataaatactaatattaaattttgtaataatatatcaacaagaaacatttaaacttcacctcaaacacagttgttaattaatgtttatttttaaaactaaaaataaattacaaaaaatctcaaataaactttgactttctttgacctttgtattattatagatgtagggaagaaaatattaatgttttgattaatatttattcctagaaataaggcgaatataaaaggtatttatatttaatgatagaattactttttaattcttaaccttaattgaatttatatactaaaaaatatatgtttggaaaaaataataacacattataaaaataagtaatatgtgtatttgaggaggaaaaaatatgaatgttgataaaatgactttaagagtacaacaagcactaaatgatgcaaatgcaactgcagtaaagtacactaattcacaaatagatttgattcatcttttttctgcattagttgaacaggaagatggattagttccaaatatctttactaagatgggagtgcctgttaaaaatttgatcagttcaataaatgctgaattagatagacttccaaaggttacaggtgaaggattaggaaatgtatatataacaagaaaagtagatgaagttttagtcaaggcagaagaaatttcaaaaaaatttgaagattcttatgtaagtgttgagcatttaatgcttgcaattatggatgtaggaaaaaatacagatgttgaaaaaatattgaagcaatatggcgtaacaaaagatagttttttaaaagtgctttcagaagtaaggggaagtcaaagagtagaaactcaagatcctgaaggaacttatgatgcacttgcgaaatatggtactaatttaacagatcttgctaaaaagcataaattagaccctgttataggaagagatgaagaaattagaagaacaataagaattctttcaagaagaacaaaaaataatccagttcttattggtgaacctggtgtaggtaagactgctattgttgaaggtttagctgaaagaatagtaagaggagatgtaccagaaggattaaaagataaaataattttttcacttgatatgggagcattaattgcaggagctaaatatagaggtgaatttgaagaaagattaaaagcagttttaaaagaagtttctagtagtgatggaaggatattattattcattgatgaaattcatactattgttggagcaggtaaaactgatggagcaatggatgctggtaatttaattaagcctcttcttgcaaggggagagctacactgtttaggagctacaacttttgatgaatatagacaatatattgaaaaagataaagctcttgaaagaagatttcaaccagtaattgttgatgagcctagtgttgatgatacaattgcaatattaagagggttaaaagaaagatttgaaatacatcatggtattagaatacatgattcagctatagttgcagctgcaaagctttctgatagatatatacaagatagatatatgcctgataaagcaattgatcttattgatgaggctggagctatgataaggtcagaaatagattcacttccaactgaattagatattgtaagaagaaaaatctttaaattagaaatagaaaaagaagctttatctaaggagaaggatgaaggatcaaagaaaagactatctgatgtggaaaaagaactagcagaattaaaagaaaaaaatgatgaaatgactgctaaatatactaaagaaaaagaaaatataacatcaattaagacattaaagagccagctagatgaagcaagaggaaaaatagaagaagctcaaagaaactttgattataacaaagttgctgaaattcaatatagtgtaattcctaaaatagaagaggaaataaaagcaaaagaagccgctactaaggaaaattatgaaggagcgttattaaaggaagaagttactgaagaagaagtttcacaagtacttgcaaagtggactggaattcctgtatcaagattacttgaaggtgaaagggaaaaattattaagacttgaagaagatatgagcgaacgtgtaataggtcagggagaagctgttgaaactgttactaatgcaatactaagagcaagagcaggacttaaagatgttaataggcctataggatcatttatattccttggacctactggtgttggtaaaacagaacttgctaaaactttagctagaaatctatttgatagtgaagaaaatattatacgtattgatatgtctgaatatatggagaagcattctgtatctagattagttggagcgcctcctggatatgtaggatatgacgaaggtggtcaattaactgaagcagtaagaaggaatccttatagtgtaattttatttgatgaaatagaaaaagctcatgaggatgtatttaatatattcttacaaatattagatgatggtagattaacagacaataaaggtaaaactgttgattttaaaaatacaataattattatgacttcaaatattggaagtgagtatttgttagaaaataagaatgaagatcatgttgaagatgagattaaatctaaagtaatgacaatattgaaaagcagatttaaaccagaatttttaaatagagttgatgatattataatgtttaaaccattgactgaatctggaataaagaaaattatagatattttcttaaaagatgttgcaagaagattaaaggataaaaatatcattattgaggtcacagatgaagctgaaacattaatggcaagggaaggttatgatcctcattatggtgcaagaccacttaagagatatatccagaatactttagaaaacagacttgctaggatgataataaaaggtgagcttacttatggttctaaggtgaaaattgatggaaaagatgatgaaataacaataactccaattccaactgttgcacatttaaattaaataatatgaaaaatggcttctcaaataggagggcactgaaaaagtgcctttcggaataaaagacctaaaaaattatttaaaaacaattttttaggtcttttatgttatacttaacttataaaataatgtaggtgattcgtatgataaaaaagcaagaaacaatgattttaagtgaatattcaggaatttatgatttggttgttccaagagataatctgttaagaaagattaatgaattaattgatttttcatttatatatgatgagattttagataagtattgctctaataatggtagaaatgccattgacccgatacgtatgtttaaatatcttttattaaaatccatatttgatttgtcagatgtggatattgttgagcgttcaaaatatgatatgtcatttaaatattttcttggcatggctccagaagaagctgttattgagccaagctcattaactaaatttcgtagacttaggcttaaagatataaatattttagatatgttaataaataaaacagttgaaattgctcttgaaaaaggaatcctaaaatcaaaatctatcattgttgatgctacgcatacagcagctagatataatcaaaaatcaccacgtgaagtattacaagaacgttctaaaagattaagaaaatcagtttatgaaatagatgagagcattaagaatacttttccatctaaaaatacagttgatgatttagaatgcgaaattaaatattgcaaggaattaatagaaattatagaaaagaacgaaggtatttcatcttatccaaaagttagagaaaaattaaatattttaaatgaaatattagaagatgatattcaacacattcaggctagcgccgatgcggatgcgaggattggacataaatctgtagattcatctttctttggatataaaacacatattgcaatgactgaggaaagaataataacagctgcaactattactactggtgaaaaaaatgatggtaaagaattagaaacattaattaataaaagtcaagaagctggaatagagattgaaacaattattggtgacgctgcgtactctgaaaaaggtaacattgaatttgcaaatataaataatattaaacttgtagctaagttgaatccttctgtaacgcaaggctttagaaaaaaggaagatgagtttcaatttaataaagatgctggaatgtatgtatgtaaagaaggtcatatggctatccgcaaagcccgtcaaggaaaaaggaatgtttctacaaatcaagtagatacttattattttgatattgaaaaatgtagagattgtctgcaaaaagacggatgctataaagaaggtgctaaaagcaaaacctactcagttactataaaaagtgatgttcataaatctcaaatagagtttcaagaaagtgaatttttcaaggaaaaatctaaagagagatataagatagaggctaaaaatagtgagttaaaacataggcatgggtatgatactgcatcatcctcaggtctaattaacatggaaatgcaaggagcattagccatcttttcagtaaatgttaaaagaatattgaagctattaggatagaaatatcctttaatttgattaatatctaaagaaaaaagagttaatgaaactaaattttttaagtttcattaactcttttttatctagatataaccgcactaaaaaaactttaagtttttcagtgccctctcaaatagagagccattttttctattgtattagtaataaaaatagaaaatatttttgtgtagataaatttaacaataacataattatgaaatagttatatataatattattgaaaaaaacacttaagaggagtaatataaaattacaatactggaaaatttataaagggagagatggttatatgaaaaaattaattaacaatcctgaaaacgttttgaatgatatgattgaaggtcttgtagcagcctatccacaatacctaagaaaactagatgattttaatgttgttgtaagaacttcaaagtcagatggaaaagtaggtctagtaagtggtggtggaagtggtcatgagccagcgcatgctggatatgttggtaagggtatgcttgatggtgcagtttgtggagaggtatttacatcaccaacaccagatcaggtttatgaagcaattaaagcaactgataatggaaatggcgtcttacttgtaattaaaaactatactggagatgtaatgaattttgaaatggctaaagagatggctgagatggatggcataaaagtagagcagattattgtaaatgatgatgttgctgttgaaaatagtttatatacagcaggaaggagaggaattgctggtacagtttttgttcataaaatagctggagcaaaagctgaaggtggtgcaagtttacaagaagtaaaagatattgctgaaagagtagttaaaaatgtacgttctatgggaatgtcactatcatcatgtatagttccagctgctggaaaagctaattttactcttggagatgatgaaatagaaataggtatggggatacatggtgagccaggagtttatagaaagaaaatttcaactgccgatgatatagcacaagaattattggacaagatattagatgatatagagataaataagaacgatgaagttgctattattatcaatggtttaggttcaacacctaatatggaattatacattataaataaaaaagtaaatgaaattttaactgagaaaggaattaaaattcataaaacatttataggtgaatttatgacgtctttagaaatggcaggatgttcagtatctttattaaagttagatgatgaattaaaggaattacttgatgcaaaagctgatacaccaggatttaaagttatataagtttaaaaacataaaataatttatggaggataatattatggttaagggcaaagagttaaaggaaatattaacttgtatatcagatgttatagatgaaaataagctttatcttagtgaacttgatgcagcaattggtgatggtgaccatgggttaaatcttcacaaaggatttaaagctataactgaaaagattaaagatatgccagaaaatgatgtgggattaatactaaaaacttgtggtatgactttggtgagtactgttggtggagcatcaggaccattgtatggaacagcatttatgaaagcatcagcagtagttaataaaaaagaaagcatagatattaatgattttgttaatatgcttaatgaagcacttgagggaataaagatgagaggtaaatcagttgaaggtgaaaaaactatgattgatacattatcaccagcccttgaagcttctaaaaatgcattagaagaaggaaaaagctatgaagatgttctttctgctttgattaataaagcaaaagagggcatggaaaatacaaaaaatataatagcaattaagggtagagcaagttacttaaaagagagaagtcttggacataaagatgcaggggcaacatcaatgtatcttattttaaatacaatagttgagaagagtatttaataaaaaaggatggatatagtatggtagggatagtgttggtttctcatagtagtaaattagctgaggggttaaggagatagctattcaaatgactccagatattaaaatagaaacagctggaggaacatgtgatggaagaattggaacagatatgaacaaaataagtactgctataaataatgcatatagtgaggatggtgtagcagttttctttgatcttggaagtgcacttatgaatacagaaatggcaattgaatttttagatgatgatattaagaagaatattcatattattgatgcacctattgtggaaggtgcagttgtaggtgctgtaaatgcaagtatgaataaaagtattgatgaaattatatcagcgctaaaagatattagaataaataaaatacagtaacaagaatatgctatatattttggagagttctgagttaatcaggactctttatttttgttcagaagtatagtgtggttatgtaaaggttttaagtgttttattgactaacatatagcttagtactagtaaaattcatgaatttcaatcttaacaaaatcttaattctactataaaaaccctaacactaccctaatatttttagtgataaacttagttcatcaaaagagaagggggaagttaaatgaatataatgattggattaataggaataatatcagttatatattttatttacttagcaaatatcttattaaggggtgacaaataatgatgagtttgatattacaatatggagtttatcttttgatattagtagtattagcaataccacttggaaattacattggtaaagtaatgaatggagaaagggtgtttttatcaaagatattagtaccgtgtgaatcttttatatataaagttttacatgtggataaaaatgaggatatgggatggaaaaagtattctttttctattatagctttttcattgattagtttagtgatattattttttattcatttatgccaaggatttttaccattaaatcctgaaaacataaaagggacaagcttagatttagcatttaacaatgcaattagttttgttactaacacaaactggcaggcatattcaggtgaaagttcacttagttattttacacaaatgataggacttacagttcaaaattttgtttcaccagcagttggtatgtgtgtgttatttgcattgataagaggattctttagagtaaatgcaaaaggtataggaaatttttggacagatattacaagatcaatattatatgtgttaattccactttcagtagtactttctttagtattggtatctcaaggagtagttcaaaattttaaatcatatgacacagtttctttagttgaaccaataactcttgatgatggaaccgtagtaactgaagaaatagttccgcaaggaccggcagcaagtcaaattgccataaaacaattaggaacaaatggtggtgggttctttggtgtgaattcagcacatccacttgaaaatccaaatgtattaactaatttatttgaaatgatatctatattattgattcctgcagcactatgtttcacttttggaagaaatataaaggataagagacagggaattgcaatatttgtagcaatgggaataatgcttgtagttgcaatgggaataataggagtaaatgaacaaaatgctactccgcagttagcgatgaatggacaagttgatatttctacaattaatcaacctggtggaaatatggaaggaaaagaatctagatttggaattgcatcttctacaacatgggcagcatttacaacagcagcatctaatggttctgtaaattcaatgcatgatagttatactccaattggaggaatgatgacaatgttacaaatgcaattaggtgaagttatatttggaggtgctggatgcggtctatatggtatgcttgcatttgctatactgactgtatttatggctggtcttatggttggaaggacaccagaatatttaggaaagaaaattgaaccatttgagatgaaaatggcagttttagtttgcttagcaacaccaatagcaatattaattggaagtggtattgcaaccttattaccacaaacagttcatagcttaaataatagtggagcacatggattttcagaagttttatatgcatattcatcagcaggtggaaataatggatctgcatttgcaggctttggagctaatacaccatttttaaatataagtatcggtataataatgttatttgcacgctttgtacctatgttgtgtactcttgcaatagcaggaagtttagttcaaaagaagaaagtagcagaaagcagtggaacattaccaacacataacatgatgtttataggattgcttatctttatcgtacttttaattggtgcgttgagtttcttcccagcattagcacttggtcctattgctgaattctttcaaatgttaggttaaaatgggggaataaattatgaatgaaaataaaagcagttttgcagataaaaaaatgatgatgagggcagttaaggattcctttttaaaacttaatcctaagactcagatggaaaatccagttatgttccttgtatatatttcatccgtattaacaactattctatatgttgtttcactatttggaattagagattctaaaccaagttttatttttggaatagcgattatattatggattacagttttatttgctaattttgcagaagcaatagctgaaggtcgtggtaaagcacaagctgatgcgcttagagcaagtaaaaaagatgtagaagcaaataaaattataagcttagataaaaaagatgaaatcataaaagtttcatcagtatctcttaaaaaaggagatatggttattattaaagctggtgaacagattccagcagatggtgaagtaatagagggagcagcatcagtagatgaaagtgcgataacaggagaatcggcaccagtaataagagaaagcggcggcgatagaagtgcagtcacaggaggaacaacagttacatcagactggattgttataaaagtttcaaatgaagcaggagaaagctttcttgataagatgatagcaatggtggaaggtgctgatcgtaaaaaaactcctaatgaaattgcattacagattttgttaattgcactaacaatgatatttttattagtaactgtttctttatatgcttattcaatgttctgtgcaaatgagcttggggaaataaatccaacatcagttacatcattagttgcacttttagtttgtcttgcaccaacaacaattggagcattattatcagcaattggtattgcaggtatgagtagattaaatgaagcaaatgtacttgcaatgagtggacgtgctatagaagctgcaggtgatgttgatatattgatgcttgataagactggtacaataactttgggtaatagaaaggctgttgaatttattcctgtatctggagttgatgagagagaacttgcagattcagctcaattatcatctttagcagatgaaactccagaaggacgtagtatagtaatactcgcaaaagagaaattcgatatacgtggtagaaatatttcggaattaaatatggaatttgtaccatttacagcaaaaactcgtatgagcggagttaattataaaggaaatgaaataagaaaaggggcagctgattctattaaagaatatgtgatagaaaaaggtggatcatacactaaggaatgtgatgatatagtaagcagaattgcaaatcaaggtggtacacctcttgtagtatctaaaaataatatggttttaggcgttatttatttaaaagatattattaaacaaggtgtgcaagaaaaatttgcagatttaagaaaaatgggaataaaaacaattatgataacaggggataatccattaacagcggctgctattgcagcagaagctggagtagatgattttttagcagaagcaactccagaaggaaaattaaaaatgattcgagattttcaaacacaaggacatttggtagctatgactggagatggaacaaatgatgctccagcacttgcacaggcagatgtagcagttgctatgaatacaggtactcaagccgctaaagaggctggaaatatggttgatttagattcttcaccaactaagcttattgatattgtaagaattggtaaacagctattaatgactagaggaagtttaacaacatttagtattgctaatgaccttgcaaagtattttgcaataataccagcattatttattggattatatccaggactttctgcactaaatattatgaatttgcataatgcgcagagtgccattttttcagcaataatatataatgcattaattattgttgcattaataccattagcacttaaaggtgtaaaatatcgagaagtacctgctggaaaattattatctagaaatctattggtttatggcttaggaggagtaatagtaccatttatagcaataaaaataatagatttaatcattacttcaataggtcttgtttaaagaaaggatgagtttaaatgaaagattttaaatcagtgtttccaaaagcttttatgatatttataatattcacaattatatgtggaggtttatatacttttgtaattacaggaatatctcaagttttgtttaataaacaggctaatggaagtattatagaaatagatgggaaaaaatatggaagtacactattagcacaacaatacacagatgataaatatttgtggggaagaattatgaatgttgatacagatacttttacagataaaaatggaaataaagttgcatatgcaggaccatctaatattagtccagcaagtgaagagtataataaattagttgaagaacgtgtagataagataaaagaatctaatccagataagtctggcgttcctataccagttgatcttgttacttgttctggaagtggacttgatcctcatatttcagtaaaggcagcaaaatatcaagaagagcgtatagctaaaaacaataatatgtcagttgaagatgtagataaaataattaataaatatactaaaggtaagctttttggaattttaggagaaaaaactgttaatgtattagaagtgaatcttgcacttgatggtattttgaaataaaaatcaatgaggaaatatattatgcagaggaaagttattgttagtgaagagatagttacagatataggaaaattaaaagttgatatatctgtcttagaattgctatctataatcgtgtatgaattaagtaaagaatcaaggaaaaacccagaagttgaatgcatatataaagataaaattttatggattctttttgataactcatgttttgaatgtgataatcttatagaggactatggagaacttgttggtttagtatcaaatgaattttcaatcacaataaatggtgttatagatacttttgaaattggaacaattaaaattataattgaagatggaaaattgaaaattcaaaaaagtaatactacaggaaaagattttgatataatttctgacttgtgcataaaaatagaagtgagaaataatgaagaattacaatttctttatgaagtactatctaatattcaatataataagacttgtatttctattagacgaaaatgggataaatatttaagtaataatagttatatgggaacaaagtataattatattcaatttgagaatatttatgatgaacagagtgactttgttaattctttaagtatttttaaaatgacagaattatggattgatttcttaaaaaacaaatatacttctatggagtttgatgtattatatgaaaattttaaaaatggaaatatgagaagaatatttgcatgggaattagcgttaagaattgcattatcaaaacttagtattcgtatagaaaattcaaatgaagattttaaaataattgatagtaatggagaacaaatacattatacttttgaatcaaaatcatcagcagaaaaaattttactgaaatttttatttccagctaatgaaagtttataaaataaaatattaacaaaatctttatactatagttaaaatatttataaaatacttattttaactatagtataatttatttaaagtaatttttgaggtgaacagatatggtgtatgaacgacctaatccagacgatgttctaaaagcaatttcaaaagaacataaaaaaaatgggaagttaaaaatattttttggatatgcagcaggagtaggaaaaacatttgcaatgcttgaagccgcgcataaatcaaaagaatcaggcattgatgttgttgcaggatatatagagccacacacaagagtagagacacttaacctcttgaatggacttgagatgttaccgaatttaaaagtagactataaaggcataagccttaatgaatttaatatagatggagctcttgaaagaaagccagatttaatattagttgatgaattagctcattctaatgctgtgggatgtcgtcatgttaaaagatatcaagacataaaggaattgcttgataatggaatagatgtttatacaactgttaatgtacagcatatagaaagtttaaatgacattgttgcatctataacaggaatcatagtaaaagaaagaattcctgacagtgtattcgataatgcagatcagatagaacttgtagatattgaacctgaggatttaattcagagattgaatgaggggaaaatatatagaactgatcaagcaaagcgtgccttattaaatttttttacaaaagaaaaattagttgcactaagagaaattgcacttagacgtacagctgatgccgtaaataaaaaaatagatattgaaagggaaaggacaaagaatagttattacacagaagaacatttattaatatgtctttcaagttctccgagtaatgctaaggttattagaacagcagcaagaatggcggatgcttttcatgggttatttacagcattgtttgtagaaacgacagatactaaggaatttcaagatgaaaatagagtaaggcttgaaagaaatctaaaacttgccgaacaacttggagcaagaattgcaactgtatatggcgatgatattgcatggcagatttcagaatatgctaaattaagtggagtatctaaaattgtattgggacgttctactactaagaaaggtttatttaaaacgaaaaaaactttagtagataaacttacagaaattgctcctaatatagatatatatattattccagataactcaaaacagaaacagactaaaataaaattaaaggctaatctttataaatttaacatggtggatatagcaaaaacatttggaattttatttttaagtacaatcttagcacttatattttttgaatttggatatagtgaagctaatattataacaatatatatatttggtgtattacttacatcaataaccacaagtggtaagagatgtggaattttaatgtctatattagcagtattaacatttaattttttatttactaatcctagatttacattccaagcatatgataaaagctatcctgtaacttttgcagttatgtttatatcatctatagttacgagtaagttagctacaaaagtaaagcttgaagctcagcagtcaacaaggaaagcatatagaacagaagtattgttagaaaccagtcagaaactgcaaatagcaaaaagtaaagaagatatatttaataaaaccgcatatcagacaaaaaaattattagataagacaataatactttataagtcggagaagggagttcttgcagagccattagtatttaagcatgaaaatgataaggatgttttagaatatatatctgaagaagaaaaggcagtagcacagtggacattaaaaaataaaaaacatgcaggagctacaactaatactcttccaggagcaaaatgtctttatttatcaataagaaatcatgaaaaggcatttggagtaataggaatacctctagagaaagatgaatttttagaagcatttgaaaaaaatttattaattgcagttctaggagaaagtgcattagctttagaaaaggaagaaataaatcaaagcaaaaacaaaatatatataaaagcagaacaggaaaagttgagatcaaatttattaagatcaatatcacatgatttgagaacacctttaacaagtatatctggaaatgcaggtattttgataaacaattcagaaattttaagtgaagaaaaaaagaaatcactttacttggatatatatgatgattcaatgtggttaataaatttagttgaaaatctgctttcaattacgaggatagaaaatgggacaatgaagataaatacagaaccagaattagtagaggaagttattgaagaagccatatgtcatataaatagaaaggtttcagaacataaaataaatacagttattgaagatgatcttctaatggcaaaaatggattctggtctaattatacaagttataataaatataattaacaatgctataaaatatacaccgaaagattctataattacaataacatctaagagaaaaaataatatggcggttatcgaaataagtgacaatggaaaaggaatcaatgaagaaagtaaagagaaactatttgatatgttctttacagataacaataagtttggagatggaagaagagggcttggtcttggattagcgttatgtaaatctattatagatgcacatgaaggatgtatatatgtaagagacaataagcctaatggcgcaatatttggatttacattacatattgaggaggttaaaatcaatgaataaagctcagatacttgtggttgaagatgataaagctataagaaatcttataaccacaacactagaaactaaagattataaatttcatattgcagaagatggagcaaaggcaatattagaagcagtatcatataagccagatgtaataatactagatttaggacttcctgatattgatggagttgaaataataagtaaaataagaacatggtctaatgtacctataatagttgtaagtgctagaagcgatgatagcgataaaattgaagctcttgataatggtgctgatgattatttgaccaagccctttagtgttgatgaattattagctagattaagagttgctctaaggagagtaaattataataatgaaataaaagatagcaatggaagtacatttttaaatggagatttaaaaattgattatatatctagaggtgtttttattggtgaaaaagagattcatttaacacctatagaatataaattaatttgtcttttagcaaaaaaccttgggaaagtacttacacataattttattttaaaagaaatttggggaaatgtccttccaaatgatactccatctttaagagtatttatggcaactcttaggaaaaaaatagaagagacaccttctagacccaaatatattcagacacatgtaggtattggatatagaatgattaagatagataataaaacaaatgataattaaataaaaaagagttattcacaaggaataactctttttcgtttggtacattactacggatttttattttatgccagattcgtattgttgtaccattctcttaaccatttctccaccaacgctaccgcattgctttgaagataaattaccgttgtactctgtaaatggaacacccatttcactagctacttcagttttaaattttgataacccttgtttagcttctggtactaatgctgaactctttgacataatatattcctcctttgaatgtaggattatttgctaagcaaatcttctttgctttgcagtattattgtgtgtattttaaaaaaatataacctatgtaattagaggaaaaaaagtaataaatatatacaaatgtaaaaaatatgaattgagaggaataaataaaaaaacaagcaataagatggcataaataaattacatcacttaatgctttgtttaaaaaattataaaaaaataacaagtcaatttgtgtgtatatttgcacttgttattttctctcatatttctaaatttttaatttcttgatttttttattttagatatagctataataactggaacacatataacagagcttacaatagcttctggtattccatttgtgattcctattccagcaatagcaacagcagcagtatcaggattaattcctaatgcagctgagtatttttcaagataaaataaataagcaaggctaagtacaccagctgtatttgtaaatgaagccagaagtgaagcaatagcaatacttatgctttccttttttatcttacggtacaaagcacgatacacataatatgcaactatacctacgagtactcttggaattatagctattataggattccaaaagataaatgaagtaggagcaggtgcagtaaaattttgatacattgaaaatagtccgaatactaaacctactaaggcacctacaactggtccttcgataatagcacctattattactggtacatgcattatggttgctctcattgtaggaagtggtataaatcctaaacctgttattcctaaaaaaatagaaatagcagaaagcattccaatcattgtcatttgtctgatagataatcttctattcttaagtttattttccacttaaagttacctccatttttattctatagttaaattagagaattaaaaatatttgcaagtaacattttatcacattcattataaatctcaattgatatcattaaaaatttcttttttatcaggcattattagagcacaaataaagtatgctaaaattgctgcaggaaaaaattcgatagatataagtatgaataacactcggattaaagtagtatcaccattaatataatcagaaaaacctgcaagaacgccacagactttttttcttgaaacatccttataaagttttttcttttcattcattaataatcaccatccagtttataatagtcaggattttataattccattattattattataaaacagaattataaaaataatagcaactataatacatatttatagaaaaataagaaaatgataatatttatataaggatatttttatgtatattaaagaaagaattttaaaaatacttgtaaatgttattacttcattataaacttttaaggaaatatgtattacaattaatagtagtgtataatatttcagtaagataatgaggtgaagaataatgagtacaattgcaggaaaaggatgtccaagaattattccagagggtgagaagaaacctttaaaggatatagaaagaagcattgtaaaaacatatagaaaacacatttggtcaaaattcgtaaaggctgttaaggaatataatcttatagaagaaggagataaaatagcagtaggcatatctggaggaaaagatagtatgcttatggctaagcttcttcaagaattacaaagacatggtcaggtaaagtttgatttagtatttcttgccatggacccaggataccatcctgaaataaagaaattattaattgaaaattgtgaacatttggatattcctatacatatatatgattcaggaatctttgaagtagttgataggatggctaaagattatccttgttatttatgtgcaagaatgaggagaggctcattatatgctaaggctcaagaatttggatgtaataagcttgcattaggacatcattataatgatgttatagaaactactatgttaaatattctttatgcaggaaattttaaaacaatgatgcctaagttaaaagcaaagaattttgcaaatcttgaacttataagacctatgtattacattgaagaagattacataaagaaatttataaataatgcaggaatatggcctttaaactgtgcatgtatggttgcagctgaaaagatagggaacaagaggtatgaaataaaggatctcataaaacaattaaaagaaaactttgatggtgtagaaaaatcaatatttaaggctgccgagaatgtaagcatggatgggatattaggttggcagaagggcgatgaaaaatattcatttcttgatgtatatgatgaggaataggctaggtatacggattgacttgttaattttttgataatgctttaattagtgtttattaatctgtaaatatatgttatattaatattaaagaaaaatcaaaatagtcagtatattaataacagaggtgcttaaatttggttatgaattattatatactagattaagtaccttatgtttacatttcaaggagaaaacttatgacaaatgaagatatgataaaaatggattcaattatcttacttagttttataaatactaagttaagagatgaatacagtacgttaaatttattatgctgtgatttaaatttagatgaaaaattattgacaaataaactacatgatgttggatatgaatataataaagatataaatcagtttagataaaatttatttgaattttattaggaggaacataaacatgaaattaaaaaagagcggaaagattattactgttttggttgcaactgcagcattaattgcatcacttgcaaatgacaataagaagagtaaataacaaataagtgatagaggattgttgaatatggttaaggggaaattggcgagcttgataagtatcataaccgagaagaaacagtttttatagaatatgacagaattacgttattaccaagcgtcgatgaatttaaaaaagttgtaaaaaataatattaaaaactctataattaacgaaacaaaagctgcattaatattatttgatatagataattttaaacatgtaaacgactcctttgggcatgaatttggggatgttatgcttaagtgcttaagtggtgagataagaagtgttttagatgacgatatattaatgtgtagatatagtggagatacattcatattatatttaaataatattgattatgaagatggaataataacaactgttgaaaaagtatttgatatatttaagaaagcacatgaagatatatatttaactataagtatggggatagccttggtacctaaaaatggaattcagtacgattttctgctcaaaaatgctgatatagctatgtatgaagctaagatgaatgggaaaaataaatttaaattttttagtgatgaaatgggtaagaaagtcattaaagaatatacccttcaaaaagaacttagaacatcattggagaaaaatgaaatttacgttatgtttcagccaaaggtacttttggaagattatacagtatgtggattcgaagcacttgcacggtggaataacgaaaagtttggagaagtaagccctgttaaatttattccacttgcagaagaatcaaaaatgattgttccaatagggacttttgttcttgaagaagtttgtaaaaaaattagatatttatcatctaatggttactcaaattttaaaattgcagtaaatttatcagaagttcaatttcaagaagaaattgttgttagtgatcttaagagattaattaaaaagtatcatatatctacaaggcatttggaagttgaaataactgaaagtatgtttatgaaatcttttgaaagtaatctaaaagttttagaagaaattaaaaaaatgggaataactatagcattagatgattttgggacaggctattcttcattaagttatttaactaaattaccaattgatgtgttgaaaattgatagaagctttattatagatttatgtttaaatccaaaggaaaagtgtatggtagaaaatattgtgagattatcacatcaattaggtatagaagttgtagctgaaggcgttgaagaagaagagcaagctgagtatttaaaagcaatatcttgtgattttgttcagggctattattttagcaacccaaaatcctttgatgaaattataaatataattggaaaaaaattataaaactattgacaaaatattttttatagaataatataagaatatgaattaaattccaggaagaggaagagtagtcaggatgcaatgtcaaagagagctggagatggtgagatttcagcacagtagctaatggtgaatgggcctctgagaagcaagatgaaatctatttaaatttggagagtagttgcgccgtgtgtcgcacgttatagcgaatagagtatgttagtacttgaagttgagtggtatttttgttaaagaagatacaatttaggtggcaacgcggatataatccgtcctatttattataaataggacgttttttttgttataaaattccgtacaaatcttctagaaattaaagtttaaattactactgactcaaactgctaactgataaaaaatcagtgggggttgatatttatgttatgaaagaaagaaataaaagagatagcaataaaaaatgatagtaataaattaatttgatagaagagggatttttattatgaatacagggttaaatacaaaaagaatgacaacaaatgcaatattaatagcaataggagcaattttacatcaaataacaccggcaataccgctttttggaataagcatgcaaccagatttatcactggctatgctgtttataataattttatataataaagattataaaactagtcttatttgtggaatagctgtaggagtatttgcagcaatgacaacaaagatgccaatgggccaaattccaaacattgttgataaatttataactactaatataatgtttgctattgtatctatgttgagaaacaagcttgatgctaacaaattgatgatgtttattttaccaattgggacaacaataagtggaactttatttatttcagtagcaattataatcggtggaatagaagtaagtgcattcattcaattatttgtaagcgtagtacttacagcagcagtaataaatacaattttaggtttcggattatttaagatagttgaaagaacagcagtggctactggtgcttactttattagtaaatagataaataaaaaaccaggtttaaagtaagatttattttactttaaacctggtttttagttttatgaaaaaatagttctattttttcataaaatgaaattcttccggtgtattttcatctattgttttaaattcatatccattgtctttatagtattggataatacttggaagtgccttaacagtatttttacttaagtaagagcaatgcattaaaagaataactctatctttagtgctctttgcattttttaatattgttgaaggtgcagagtttggattagcgccatcaccactatcagtattccaatcataaatttttaagttgttatcatgaagtaaatcaaccatggacttggaaattttgtatgtgttgttattgcatccaaaaggaaagcgcaatatagttggttttataggaaccactgtacttataagttcctgagtacttatcatttcttttagaaattgttcgtttgaacaatatagagaattctttttatgtgtcatactgtgaagtcctatagaattgccctcatcataaattcttttaaccagatcttcctgatctttaatttgacatccaattagaaagaatgttgcatgaactgagttgttttttaatatgtctaaaacatcatttgttacctttccagcaggaccatcatcaaacgtaagatatacaactttagaattactttcaacattatttttttcatcagcatatgtattgtatataggaattgaaaaaaacattgtgattattaaagaaaaaagcgttagtttttttaatttttttaaatacatgtaatcaccttcataaaaaattttatatacacatagtatgtacaaatatttaaattttattttaaaatatcttaggtttatagatgatatgaaaaaaattgtttatttatgttgaactatagtttatatggtgatataatttgaaagaaatttatattaaattttagatttataaataaatattaaaatattttctaaaagacatattttaattctagtccagagaggctaaaaagggagaatataacgttcttcttttaaatttgaggaggtattgtatgtcagaattaacaggaatcacatctgaaggtattaaagagtcaacagtaaggaaaacaggtatgagaattattatggctctccaacatcttattgcaatgtttggatcaacagtgttagtgccaatattaacaggacttgatatttcagtagcactattttgtgctggacttggaacacttatatttcacttatgtacaaatagaaaggttccagtattcttaggatcatcatttgcatttatcccagttattatagcagtaggagaaacctacggagatttaacatatgctcaaggcggaatatttgttgcaggtctcatatatgtaataatgtcatttttaattaaaaaaattggaactgataaattaaaagcagttttaccagcacatgtggtagggccaatgataatggtaattggattaaatttaattccaacagcatttaacatggcgaaaacgaatattataattgcagcaataacacttggaacaacattagccataaaatattttggtagaggatttttttcacagatagcaatactttgtggtgttgcagttggatatacaatatcattattttcaggattagttgatacaggagcaatagcaagtgctcaactaatggcagtaccaaactttactcttcctaaatttgatataggtgccataatgatgatagcaccagttgtacttgcaacatttatggaacatataggtgatataacaacaaacggacaggttgttggtcaggattttataaaggatccaggattgaatagaacattattaggtgatggtcttgcaactataagtgcatcattgcttggaggacctgcaaatacaacttatggtgaaaatacaggtgtattagcaataactaaaaattatgatccttctcttttaagattagcagcagtttttgcaataatactaagttttatttctaaatttggtatgacaataagaactattccatcatcagtaatgggggaataagtttaatgttattttcaatgatagctcttgttggagtaaaaactataaggattgaaaaagtaaagatgaattggaaaaacatgattgtaatgttatctatattaattatagggtttgtagggaagcttatagaagatagatatggaatacttataggaataaaaattacagacacaatttcaatgtcaggactaagttttgcagccgttgttggtgttatgctaaacttgattcttaatggtgttaaaagaaataaataatatagaaaataaaatcagtataaaatactgattttatttttttcttttttaaaattacaaacatatgctaatatttgttagaattattcaattaattagagttagattctactattgaaaaagatgagtatatggtataatttaactataatgtttacaataaatgacttcggagaaaagagatgagtggtatgagaactgttaataataggtacctaattgatgaagaaataagtaatgaagaaaattattgcaaatacactgttagagattgtgaaagttatgatagatttgtattaatcatattaaaaaatgattttacatatgaaaaaactcaagaatatttattgaacaaattcaaaaccataaaaaatcttaactgctcaaatgtaattaatttattagaatttcagattatttataacatagatggaataaagcttgataaatatcagtatggatatcttatggaatacattgatgtaccagttagtgtacaggaatacattggagtgtgcacaacaaaagaaaagattgatatatttatggagttatgtgcagtaattaatactttaaacattaaagggtatatatttaaggatataacatggaaagatatagttttattttatgacaaaacaaaaaatgtacatttaaaaattgataatattttgcaaaatgaaataagcaaggttagtcttattaatgtttcaagaaatgaaaagccttacccttataatattgaaaatgtagatgaatcaacaatattaaaagataatattagtgaaataatacagtttttagataaaatgtttacggatgaagaactatatggagaattgaaagaactaagtgatataaaaaaaaggtttaatcaagttcatacaataaataaatcatataatttgaattattttataaaatgtgttaataacgccttaggcaaaaagtatgattattttttaaaaaatactttaaatataatagaagataatatagatataattggaagagaagaagaaataaaaattatagaaaagaattataaaaacatacttgaaagtaaaatcaaatataaagttataggatttaatggtgatactggtagtggaaaaacaagattactgaatgaaataaaatatatccttgaaaataagtattttaaaaatataacttatattgataattttataagtaagtcaaagaatgagacatataaaaatatattagggtatataaagaataaatgtgatagagctctttatgataaatatgatatttacataaagaaatttatttcaacatgcttagagggtgactatgataacgttttaaattatgataataaccagcagtttcaacttataaatagagtaggaaagtttataagagaatatactaattcaaatccacttgtattattaatagatgatttagataaaaagaataaaggtttaaaagaattggtgagatatttatcatttatgggaaatagtctagaaaatattatgatagtattttctttaaatgaaaatagttgtgatgatgaatttttagaataccttaatgaattaaaaagggttgaacaatatgaagagtataaaataaattttttcaatcaatatgatactacaaaaatgataaagaatattttaaatactaataaatctttaggaaaactttcaaataaaatatattcagagacattaggaaatccacagtatatacgtgaagtaatagaagaattatatagtaatgatattttgtattttgatgaagaaagttcaaaatggagaacacatgtaaatattcgagaaattttaattcccaaaacacttgaaaaaaaacttgagacaagtctctcttcattgaatgaacatgaaatagggatattaaaactattatcaatatatgaaacaccattatcagaaaaaataatttttaaaataataaataatataaagcaaataagaatttataatacattgaaaaataagggatatttcatagataaaataagtgatcaaggattacttgttggtttttcaaacaatcttttaagaaatatattgtatttaaaattagataaagaaaagaaaagatgtatgcataaagatgctgcaaatctgttaaaagagactttacattcaacagattattatatggaggaatttttgtttcatcttgaagaatgttttgattttgaaacattatgcatatatgctttgaagtatgcagaaaaacttaaatcatgtgcaaattatgaaaaagcattatcatattataaaaaagttttaaaatattcaaagagtgatcgtattgaagcagcaataagaattgctaaaattcatgaaaaactttcaaatcataagaaaagctttgaatattatgaaaaagcaaaaaaaattgcaattgaagaaaagaatattaatataaaatcttatgtaatgcttgaaatggtaataatacagattaattcatctataaatataaactcagatattgaaaaaactttaattgatataagaattagtttagacaatataaattcacctaaagaagaagcatattataattatgctttatcattaaaatacagagcacaatttaattataaaatggcgatagagtcagctaagaaagcacttaatatatgtaaaaataatgagataaatggggatatatatgcttggagtatggtaacccttgcgactatatatattaaatattcaatgtataatgaagcaaaggaactgtttttaaaggcactggaagtattcgcgaaaaataaaaataataatggaattataataagcagaattatgagcacatatatcgattcagaagaaggaaagccatacaaatctatacttgaagaatatcatgatatagagagattgagtaataaattaaaattatataagagaacaatattgacattaatatatatatctaaattttatattagccaagataaatatcaagaagcagaagaatgtttattaaaagcgttagctatagaaagagaagaaggaatagatttttattcgcttaatatatgtactaatttatgcattgtttatttaaatattggaaagcttaagttagcagttaaatattattcattagtaaagcagatgaaaaaagtagtaccacttttagaggaggatattattagtataaatagtacaaatacattctataatatgtttatacataataatataaaagcttatgaatatttaaatgaagaatttaactttaataaaattactagatgtgtgtattatatgttaaagctatatatatgcaataatgacggtgaaataagaaaaacttataaagaattattagaaaaaattaatggtttgaataataataataggaaattgaaaattagagtttcatcaataaaaactatcttagatttaggatactatgaaacggcaaaagagtttttttatgagatgaatgaatatcctaaagattataatacagaggggatatatgtttatcttgaatttaagtttaaaaataggaactcatataattttttaataaataaagcattaagattatgtacagttattaatgacaaaagaatttgtgcagatttatatggagtaattgcagaaaaatatgaagaattaagttgcaatgttttcgcattaaataattattatgaatctatagggcttcacatagatataataaatatattaaatgaagaagataagataatatatgcaaataatagtagatttttagatgtaagaaaaaaacttatattttgtttaagagaaaagatgaattataagatagtgtattccaatattgaaaaaataaattatattgaagaattaaatttaataattgatgaaataagtattaagaacacattaagtgatagaaatatgtataagttgatgcagaaaacttatgaaaaatgttactataatgactttagtagttcatatgatttatttaattcatttacaagcgatatacttgaaaatatggaaaatgtaatgaaacatatggctagaattacgttggcagataaagcaatacttgttattgaaaatagtaacggagaaaataatataatatgcacatatagactcagtgacaagaaagagactgataggtatttttctttgaagctagaatcagaagaggatgtaattgtagtaagcaacaatcataatagacttgatcatcttaatgatgaagtacttaaacatgggataaaatcgtgtatatatatgaaattaagaaataaggataaaagtataaatagtgagagcagtgtaaatggacagcttatattaattgctactaatgcagtaaattatataaattcagaatcaaaaaagaaaattgaaaagtttaagccttttttaacatttttacttgaaaaatataaattaacaataagttctactttagataaactcacttctgtatataatagaaaatattttgaagaatcactggtatatttactagaaaaatcaagcttcaataataatgaatttgcagtaataatgtttgatattgatgattttaaaggagttaacgataaatatggtcatcaagttggtgatgaggttttaattaagctaacaaaagaagttaaaaggagtataggtagaagtgatattataggaagatatggaggagaggaatttgtagttcttcttccaagtgttgataagttaaaagccattaatatggctgaaaaaataagaaataacgtggaagatgctcgtattttaggagataagagaaaggttacaataagtataggaattgcaatgagtggccatgaaagaataaatagtgaagaaattgtaaatcgtgcagatcaagcattatatatggctaagcatgaaggtaaaaatcgatatgttctttgggatggagaaaaaattataagtaaaaataccaacaccaataatgagctttcaggaatattaagtggtaattcagcaaaggattataatttcatttctataataaaggatgttgctgtcattattaaaagtaaaaatagcaaagaaaataaaatgtatgaatttgtactgaaaattatgcagataatagaatgcgatagtgtaacattatttattattgataataatactataattaatataatgagtaaagataggttaaaagatggttggaatgtaagtgaaaagtttaatttcaaacttgtatatcaaactattgaaaataaaaagggaatgtacaaagttgattgggataatataggaaagcaagataaatacggcataccggattggaagtcagtttgtatagttccagtagtttgtaatgaagaagttattgcgctaatatatctttctgtttctgtaaataaaaaggaatttactgtaattgatttaaataaacttaatttttttgcagatatgggaattccaatatttgaataaattaaatcaaagtaaagaatatcattttaagaaatcacaatcacataaaagtatttgaagccatagtatatatagagatacaaattagaaaggatgcttttatgagtggagataaatacactgtagataaaagtcaaaaaggtgatttaagagttaatttatcagcaggagataataaaataaaatattatgaatgtggcaatgatagctatgtgtttgaaattttagatgatcaagtatgtcatgaagaagataaatgtgaatgctgcaatattgaaccaaaagagaaggaaataaagcatgaagagaaaaaagagacttttaataatggaagaatagtggtaaagtcaataattgattgtggtaaacaggaagttttaaaaggtgtaaaaatcaatttatataaaataaatggcttatcaccaattctaattgaatcaaaagttactgatgatgatggggaagttgtgttctcaaatattgaagaaggttcatatagaataatagaacttattaataaagaattttttgagaaaccaaagtatattaactggaatgaaataacaattgattgtaataacaagaaagaaaaaatattaatagtgaataagctaaaaaaacataaaagtacaagtaaacataattagcttataaaatctacattagatattttaatatatttaatgtagattttttatgctgtattaagttataatctatatgttgtaattgcaaagcaatgttgaaagaactatatgatttctagattataattgtaaagtttagagtacaacatatatctattaatggaataaaatattatataataaatcataaagtagaggagaaaaaagatggaatatacattaaagataaaaaagataaatgaaaaggcagtaattcctaattacgctcatgaaggagatgctggtcttgatttatatgcagttgaaaaattagtgttaaatccaggtgaaagaggtcttgttcacacaggaatacaaatagaacttcctaaaaatacagaagctcaaataagacctagaagtggattagcattaaaaaatggaataactacattgaatagtcctggaactattgatgaaggatatagaggtgaaattggagttatacttataaatcatggacaagaaacttttgttgttgaagaaggtatgaaaatagctcaaatgattgtaaaacctgtttatagggttaatattgtggaagcagaagagttaactgactcagaaagaaaagctaatgggtttggatcttctggaactaaataacatatttatccacagaaataataaaaatacatattgaattaagaaaaactgtggataaaaaagttgatagttaggagtaaattaatccagactatcaacttttaattgtaatttttaacaaaaattattcttccatagaaagttcttcccatttttcatacatttctgagattaagtcttgaacaattttaatttccttatttacacgttcactttcagcaggatttgaataaatttcttctttgcataaatcttcttgaagagaaacaaggatttcttcttttttgcttatttcatcttcaagtttttttatttcactcaatttagctttagcttctttttctaaggcttttttcttcttcttttcatctttaatagcagtttttgtttttccgtttgctgttccctcatatgtttcaaatcttagtggatttttctttttttctacataatagttatagttaccaagatattcgtgtgccccatcttcttgaagttccaatattctatttataactttatttaaaaagtatctatcatgagaaattacaataagagttccatcatagcttaaaatagcatcttctaaagcttctcttgaaggaatatcaagatggtttgtaggttcatcaagtaaaagaagatttgactttgaaagcatcaattttaaaagatttactctacatctttctccaccacttagtttattaatttctttaaatacttcgtcatttctgaataaaaagcaaccaagagctgttctaagttctgttgtagtcatttcagggaagtcatcccaaacttcatctaatattgttttatccaggttaagatttgactgttcttgatcataatatcctacattaacatttgcaccaagaacctttgatccagagtcaggctttattttatccataattattttgaataaagttgttttacctcgtccgttttcacctattagagctattttttcacttctttttaaatcaaaagaaagattagagaataatttcttttcaccataacttttacttaatttttcaacatgaagaacatcatagccactttttacagatgcctcaaactttatttttgatgcatttttttcaacatcaggagcatctaaacgctcaattttttctagagctttttctcggctttcagctctttttatacttttttcacggttaaaggatctgaatttttcaattattgcttcttgtcttttaatttctgcttgttgaagattataggccttaagttttgcctcataatcttttttcataagttcaatagaatttgtgtatgaagcattataacagttaacatgaccatttataacttgaaatgtagaggttgtgacagagtctaaaaaatatctatcatgggaaattacaataacagttcctttataagcttttaaatattcttcaagccattcaattgcatctaaatcaagatggtttgtaggttcgtcaagaagaagtatatcaggttttaataagagtagtttacaaagtgcaactcttgttttttgcccaccacttaatgtagagattgatttatcaaaatcactttcagtaaatcctagccctttgataacacgtgagatttcagctttatatgtaaaaccaccacgattttcataaaggtcttgagcagttccgtaatcttttattattttctcatgatattcagcattgttaatatcataaggttcattcatttttacttctaaatcagcgatcttcttttcaagtctttggagatcatcaaaaacaagaagcatttcatcatagatattattacatgaatcaagtgataaatgctgagataaatatccaatagtcttattcttatcaatgaatacttcgccatcatcataggaaatttcttttgttagaatcttaaatagtgtagattttccttcaccatttgagccgataattccaaccttatcaccttcattgatggaaaatgttatattttttaatacttcagttataccataacttttgcatatatctttacagcttagaacaatcattttttatcctccagttttttattctataataatcgcatatgtaaatactaataagacatattacataatatttttaaactttaaagttttagcttataaagcttaaatcacaattagatttagtagaattgacattaacaaaataaataagaatatatagtagaaaagtatatattctatagaaaattacaattataattgccaagtgccaattataataattataccattttattataggaatattaataagacatgacaagtaatgtagtgtagtttacatttttaaaggaaatatttaaaattatatataaaatatcatgttaattttgaatttattattttaagaggatataatttatagtgggtaatattggaggtgtttgtattggaaaataaaaaaatgaatattaccatgaaaaaagaattaaaagaaagagaattactttcagcagcgtataaactttttattagtagaggaatagagaaaacatctattgatgatatagttaaaatggcaaatgtgggaaaggggactttctatttatatttcaaagataagtatgaaattttaaataagataatattaaaaaagagtaatgaggttataaaagattgccttgaaaaaacagataagcttggaattatagattttaaagaaagaacattgatattcatagatcttataattaaactttttgaaagcaatcagtcacttttgaaacttataaataaaaatatatcatggggtttatatagaacagcaatgatggatcaaaaggagtatgatgaagtaaaacatgtattagatgttttcataaataatcttatgaatgaaggaatggataaaaaagaagcagagttaactttatttatggtaatagaattagtgggaagtatatgttatacgacaattatatttaaagagcctacagatataaacactatcaagcctattttatttaaaaaagtaagagcaatgatagaatcataatttatatttagtatatgaactataaagctgataattagtaaataaactaattatcagctttacatatctagaagttagaattactttttatgtcttggagttttaagaccatcttttacaagaatatatcctaaaggtggtgttttgtcatataatccaatcatatatattgttatatataaattaggggttagatgtatatcacttatatatttgctgaaattaccatcagaagtagatactataaagttatagactccaggtgatgttggatagtaattatttgtttcaagatatgaggtttcattaaataaaactctgtcatctggaagtctaagagaaagtaacggtgctgtaggagctaaattaataaatctaacataagataaaaacggattatacatcgtatgggaatcatccactgagaaaaatgctattttattgtcttcaaaagttatattaattgtagatatactgtctggaagaacctgaagaggttcggttatatatggtttatcctgacttcctgatttgactaatttaacagaatatgtttctggtggtacaggtatatagtgtgttacattcccaaaagataaaccagtaaatataattttatcattaaaatatatatcgatattaggtgcgtcaggaacattatgaataaatctaacatatccctttattttagggagtgaatctctgaataaaaacatattatcacctactttttattattgtatagtaaagaaagctttatgagtctttttgtaacgacctttattattggagaaggcataccatatagagaaaatgaatggtttattcctggatttttattaataatttctgcatatattttgttaacatcattttcgctataattactatttaaatctgaagcttcatcaatatcaagatctaatcctcgtaaaacttcaaatgtttctggattcctttttaaatcttcttttttattttgattattattacatcctcctaagctgttatagtaacagtataattggtcttcatctgtttcgtctggatataagtctaaagattcagtttcttcatcataatcagtattaatatcatcatccatagataggcttctgttaaaagatggtggtataaacttgattgtgtttcttaacttggcttcagacatatatttttcatcaggtttcattaaatttcctccttatatattaaaattaaatatcaacaaaaacagttgctgctacttctattaatatgaatttatgaagatatatagtacatgcacaataaatcttatgatggaatattatataactggaggagatgcattatgaggataaatagtaaaaagaacatcagagatttgttcattggattagatgaaaaagtgtgtgattctgaagggcgttgcatagatggaataaattttgataatgcggctaccactccacctattaaatctagtattgactgtatttatagattgggcaatacttatgcttcaataggaagaggaacaggtcagaaagcagaaataactacagatttatatcatgcgtcaaaagagtttttaatggatttctttagtgttaaagataaggacaaatatgttgtaatatatgttaataatacaactgaaggaatcaacaaattatcaaaaactcttttaaaggaagatgaagatgaggtagtaatatcttctagaatggagcatcactcaaatgatttaccttggaggaacaggggaaaggttgattatattgaagttgacgaagatggtcgtcttaaaattgatgaattagaaaaaaaactaaaaaataactttggaaaagtaaaatatgtatctcttactggggcttcaaatgtaacaggttatgtaaatgatattcattatatagctaaaatagttcaccaatatggtgctaaattaataatagatgcagctcagctagtaccccataaaaaagtagaaataagtggagaaacagaagcagaagacattgattttttagtattttcatctcataagatatattctcctttcggcgttggtgtaataatcggacttaaggaagagtttgaaaaagcagatccagattatgctggaggcggaactgtggatttggttttagacagagaagtgacttatttaaagccacctgataaggatgaagccggaacgcctaatttttttggagtaatgtcattaattaattcattaagtttaataaatacaataggatatgattatatagaagaacatgaaaaaattctattagatcatattttaagtggacttaagagcattccaggaataattaattatggagatgtagaagatattagcgatagattaggaattgccacctttaatatagataaaatgtatcatcgtgatgttgctgaaattttggcaaagaagaatggaatatcagtaagacatgggtggttttgtgctcatccatactgtagaagattgatgaatgtaactgaggaagaagccaagttgtttttagaaaatccaaatgaaaaaatgcttggtatgataagaataagctttgcaatatacaattcagttaatgaagtagatacatttttaaatgttatagaaggtatatgcaaaaataatattaaaaaataatgtaaaaagggatgtataaatttaatacatcccttttagttttataatattggcttaatcatcaatcttaaattagttaaatactttatatttaggaaggtttccttcataacttaattcaggtactccgtttataagtggttcaaaatatgaaaaggcttcatttgtaataaaattaccatcttcatttatccattcagcagggaagtatcttacattgtttgcgatttgatccgcatcaactaaagaatatgatactttataaggagaatcacattctctttttattgtaaccatttttccagtttcaccttcataagcatatctaagtgccatttcgccaaccgtataagcttcaattaaatccgtatcagaagcacagtgcattgcacatctttgaagaattccaagttctagtgccttaactcttgttgttatgttagcatcaagtataaggtttcttaaatagccagatactcctccaagttgggcatggccaaagttatcttgagatatacattcgaattcagaaacgaatttaccatttttatctcttaaaccttcagaagctattatgtatactttattattctcttcaaaacgttttttaacatcttttaaaaatttatctttatcaaatgcaacttcaggaagataaataaaatcagcaactggtttattgtttaattttgcagtacatgctgaggctgcaagccatccagtatctcttcccatagtttctaaaatgaaaattccattattaatatatactgatgcatcaagatatgtttcaagtacagtagtacctataaacttagcagcacttccaaaaccaggtgtatgatcaatatattttaaatcattatcaatagtttttggtatacctataaatttaatatctatattattagcttttgcgtattttgcaagctttgcagtagtatccatagagtcatttccaccaacataaaagaaagcttttatatcatattcttcaagaatgctcattaatttattgtattcatctttacatgtatgtgcatcctttaatttatatctacaagaacctaatccagaagatggtgtaaatctaaaagtattaatttcttcatcagattttgaagaaagatcaataatatttttatttaatataccttcgattccatttagtcctccataaactttatcaaatgccataagttctttatttgcatgaagaagacctacaacgctagaattaattacagaagttggacctccagattgggctattatacaatttgacattaaacgtcctccttatttgatacactataattataaatatagtatactgtttaataaaaataatactctgtttattaatatacaacaaaatagtaattaaataaaggctttttgacaaaaaatgaatataaatatagtatagtacagaaaatagtatgatatattaaaatgaaaagcttttaaatgatgctaataataaaaatactcataataatataataattcaaataatttactttatattccaatattaattttataaagaatgtgcggttaagtagtcattaatagaagacatatttaatattaattaataagcagaaaatatggctgtaaaattacgtattatttataaagagtaattaataaaggagtaaaagatgagtatatattatgtttttattataggtatagcactagcaatggatgcatttggagtatctttaggagttggattaaatccaatattaaaaaaaagaaataagataaagtttatagtatcatttgcattttttcaatttttgttcacttttttaggtggaattgcaggacacctatttgatgtttatattactagcattccaagtattgctggagggatagtaatgagtgtagtaggtattgttatgataattgatggattaaaggaaaaagaaagtgatcttcttattaaggatagtacatgtattatcttaggaatatcagtaagtatagatgctcttgttattggattcactacattttgtaaattgagtagcataataatactattagtaaactctatattgattgggttaataacattatttttatgtacacttgcatttttcttctgcagatacataaaaaaaattagttttataagtaaatatgcaaatttcttaggtggaattgcacttatcatttttggtataaaagtgattttcttttaaaatatttgtctatatttatgttataatatagataatatttaattgttaggagatatgaaagtggaatcacaggaatttcttaaatcaaagaatataaaagtaacaagaggaagaattgaaatattagatatattaaaaaatgcagaaagcagtctttcagctgaaaaaatatatatattatcaagagagaagagtataaatattaatttgagtacagtttacagaacattagaattatttgaagaaaagcagataacagaaaaaattactcttacagatggagtattcgcatataaattaaagaaaaaaactcacagacatcatttaaggtgtgatgtttgtcataaagaaatagatattccatgtccaatgagtcagattgaagaactggttcaaagtgaaactggctttactcttacagaacatgatttggtgatgaagggtgtatgtaaagaatgcaaaaataataaaaataaagaataatttaaaagacacacaataaattttacatgaatttattgtgtgtcttttattattcttctggactgattaatctttttaaaatcaatgtgaatattaaaataataacagaggtaagggcgattgttccaccaggcgcactgttcatgtaatatgatagaacaagtcctgacataacatctataaatccaaaaagtattgaaaatataagtgtttttgtaaagcctttttttaattgcatggcagttgcaaccggaacaactattattgaggatacaactaaaattcccataactcttatggataatgaaattgttgctccaactagtattgtaaatatgtaattaatgagttttacattaataccagctgtgtttgcaccgctttcatcaaaagtaacgtatataagtttatcgtatataaatattagtgttataagacatatgacaccaacaataccaattaaaactatatctgaaactgtgacagttaaaatacttccgaataaaaatgaatctactttagcagtggcttttccgctacttgttaatataattgcaatacctaaacttagtgtaagaacaatagacattacaagttctgcatattttttatagtatgttcttaaatattctataacaattgcacatattgttgtaaaaacaaatgcagttaaaagtggatttgttccaaaaacaagaccaattgcgactccagcaaaggaagagtgagataatgtatcaccaatcatagagtaacgtctaagtacaatgaacagtccaataaatggacataatattgaaactataaagccagcagcaaatgcattttgcataaaacctaattcaaacatttttttattaccttcctaaatttatattatattggatatagaattttcatgttctaaatacttaataaattcatcctttgtatataatttcatactaccattctgtagttttaatatatgagtagaatattttaatgctgttcgtgtattatgttctacagatataattgtcttaccatgatttttgtttaaatcttgtaatagtggataaatttccatctgacttttttcatctactcctgttgatggttcatcaagtattataagatcaggattaccaagaagtgctcttgcaataaagattctctgttgttgtcctcctgataaatttcctattaaattatttttaaagttatccatatttactttttctaaaacattagaaactgcatttggatcttttagttttattgcctttgcatgagaagataaaacttcttttactgttataggaaattcagcattaaagttatccagtctttgaggcacataagaaattttttttgtatttatttcaattgaaccacaatctggttttaataatcctagtatgagctttataagtgtacttttacagctaccattttcaccaagtacagataaataaactccatttggaatatttaaatttatatcttttaataaatcatttcctttaatatatgaaaatgacatattttttattgtaatcaaaaaaatcaactccctgaataaattttaaattgtaaagagtatgattgattatattaatttaaaaattaatataattcaataaaataccattgtttattatacatctatctgcaaatgatttgcaatatatataaaaaaataaaaatcagatatatttaagatatttataagattatttacattgaataataacaatcataggtatacaataattagggaaaaattgaaaaaaggaggaagaaatgataaagaaatttatttatctcttaattcctttttttgtagctgcaataaccgcaattatattaaataattttttagataagaatataaacagcatgctagaaaaaaaggcattatcatgggcaggaaaagagtataacagtgtatataaggataaaggtgtagtatttaataattattttgctgataatgattatgttttattgcaggcgacatcagagttaaatgcacctgttccgcaggcacctataaattttttccctataaaaggaatgaatgatgttgaaactgtaggggtacagggatggcagagtcttactcatttatctatactaggaagtcaaagtactaaaaataaagatagaaaagttgctattatagtatcacttcaatggttctataataaggatggaataccacctcaggactttcaatcaagttttgcaccagttcaattctattcatttttagaaaatgatgaaattagtgatgaacataagaaagaatatgcttctagaattgatactttgttgacaggtacattacagtatctaccagaaaagctttattctcgtttatatgtaaaagacgacattatttcaaaaggaattaagcttgtatttgagccatatttttttacaagggaatatattgttaagttaaaagataaaggactcttgtataaaaagttaaaaatacttggagacaaaaataatgaagaaataagaactgtaaattggaatgaagaatttaagaaagctgaagaagaaggtaaaaagcaagtaactaataacgattatatggtttatgacgattattataataaatataaatcaacccttaaatcaaataaagattacttaaaggacagaaatatattggattcaaaagaatacgatgattttaatttgtatttagatatatgttcagatttaaaaataaaaccttatgtaatactaatgcctacaaatggaaagtggtacgatgatcttggaatgaagaaaaatgaaagacatgaattttacaaaaccatacaaaagatggcagaaagcagaggctttaaagtattaaatttttatgatgatgaatataagccttattttatgtgtgatgcatctcattttggatggaaagggtggcttgatgtagatgaaaaactttatgagcattttaaaaattaataagtttttagtattttctataatgagttcgataattataatattagcgatattgatagcggtttttgaaccattcagtgaaataccgtttatttataatcagttttaaaggagtagttttaaatgagaattttaagcgctataaaaaagtatgcaaaaagcaacagaattgcattaaagtgcgatggagaaattatgacttatagggaattagatatgttatcggaagcaataggatgctttttatgtgaagaaatagaacaagataacaaacctatagttttatatggaaataaagagaatataatgatggctgttatgattggagctctaaaatcaggaagagcatacattccaatagatataagttatccgaaagaaagagtagatcgaataattgaagaagttaaaccagatgtactatttgattttagtgaaggaaatacatttaatgatattagagtaatatgtaattcagatataaaagtaatatatgaaaaatacaaagaaacaactgtagataacagcaaatgggttaaaggtgatgaaaatgcttatatattatttacatctggaagtacaggaaaacctaaaggtgtacaaataagtagcaataatttagataatttcgttgaatggattggagaatatttaaatttagatgatagtgaagaaatattcatgaatcaagcagcatattcctttgatttatcagttacatcaatatatcctgggttatgctatggaaaaacacttcatggattttctaaaaaaacactttcgaatttaaaggaaatgtttaatgatatgagtgattcaaatatgaatctttgggtatcaacaccttcgtttgcaggaatgtgcgtagttgaggatagttttaattgtgatatgcttcctaatttaaaagcaatggtatttataggagaggtattaccaaaaacattatgttctgagcttataaaaagatttccacagacaaggataataaatggatatgggccaacagaagctacagttgcagtttcaataaatgatatgactaaagaaatgcttgataaagatggaagtttaccaattggatttgccatgaaaacatcagtagtaaagattgttgatgaaaatgaaaatgaagttgaagaaggcaataaaggtgaaattataatagtaagcccaagtgtaagtaaaggatattttaacaatgatagtatgacacaaaaatcatttttttatgatgattataatggagaaaaatgcagagcgtatagaacaggagatttaggttactacaaagagaaaagattatattattgtggtagaaaagatttccaaattaaactcaatggatatagaatagaaatagaagatattgaaaataatcttataaaagttagcaatgttaaaaatgcagctgttgtacctgtaaacaaagatgataaaatagcatatttaactgcatttattgaactaaaagaggaaaatggattaagtagtttaaaaaatggaatttctataaaaaaagaacttggaaagcttataccatcatatatgattcctagaaatataaagataataaagcagtttccaactaatgtgaatggaaaaattgatagaaagaaattgttagaggaaataaaatgaatttaactcaatatggtgattatttttatctttatatattatttgttatttctgttccagtaataatattaaagtctttaggattaaagactaaatattatggtttgttggtatctatagttttagactatattgtaataggtggaactataggtgtaaaattatttgctttatttcttattggtgaaacagcagttatatatacgtatttgtttataagaaaaagaactgataataaatatctatactttctatttttatttttttctatacttccattaataatagtaaaaattgctggactaacaagatatgccaatatactaggttttataggattatcgtatattaattttaaagctatacagattattatagagatttatgatgaaagaattaaagaaatgaattttttatcatatatgtattttatattatttttccctacattaagttcaggaccaatagataggtggaagagatttgaagaaaatttatcacaatctattccgacttcagaatatcttaatgattatttatttgaaggtattaaaaagataattataggggttttgtataagtttgtaatatcttatataattcatacctattggattttaaagattccaaaagatataaatttaattaatagtgtaaactatatgtatgcctatactatgtatttattttttgattttgcaggatatagtctttttgcaataggtgcaagttatatttttggaataaagactccagaaaactttaataagccatttctaagtaaagatatgaaagagttctggacaagatggcatatatcattatcaagatggtttggagactatattttttcaagatttgtacttaattcaatgagaaagaaaagatttaaaaacagatttatagcatctcatgtagctcagataatgacaatgcttgtaatgggactatggcatggcttaacgccatattatattttgtatggattatatcaagggtgtgcattagttcttacagatatatatcagaggaaatctaaatattataaaaagcataaaaaagacaaatggtttcaaggtttacagattatagtaacgttccacattgtatgttttggaatgctaatattttctggatacttatttagttaaaagtttaaaagtgatagttgaaggaatttgttaagttaataggaatgtgtaggtgataaaattaacttaagcttttgattgtcaattaaataaataaaggagaagattaggatgaaggaaaaagtattagaaatatttattgaagttacaggaaatgacgaaattgcagaggacttagatttaaatttatttgatgcgggattattagattctcttgcaattatagaagtattattaaaaattgaagaaaatttaggaataaagcttcaaccaacagatttagagagagaagatatgtctacagttaataaaatgacagcatttttagaaaacagataataagaaaaatagtaatttaaaaataaaattagatttaatttttagtaaatttaatttaaaataattagagtttaagacactagacttttgatcaagctttttatagttatagtcctaataacaaaactgtaactataacaagaaagatttattgtttctagtgtcttctattatttttgtgatatttcatttacgtgccagcttttattatcatcttttgtaaaagtaccttcaagtgaaattgtatgatgaggttttgtttttgataagcctgaaacctcaactgtagcagtgttaccatcataattaataagactcatatgcttaactcttaaaagagaatctgcatcgttatcattattagtaaagttatattcaacggcgaaatataagtcttttgaatttaataatacataaaaattatgtgtgataaagtatgaactcataactatgataccaatggtaataatagaatatatagatctattcttgcgaggtttgccctttgttttttttatcttttttggcttttgatactcatatgtcataggcttttgttttaatgctaaattagtattcatgaaaacctccagaattattttgtttctaatattttgttaaataatagaagcgtatgattaattaattttgtatttgtaaaaatataaaatgaataaattgggccttaaaggcatattaacataattttaaataaaataaaattaaaatcgtacgaacaaatttattgatttacgataaattttacctacaatggatatgaaagatatttttttgatataatctaagatatactcagaattataagccaaaaatagtatatttatgttagaattagttcaaaaagagttatagaaaaaataaaaataaataggatggtgtaaatattatggatttttcaagtttagtgttaatggaaaaggataaagaaacaggattcataaagaaagaattaggaagttttgaagtgaatgaaggcgctttatatgtgaaaaaactttttgttttagacgatacagtaaatttatattttgatacaaataaaaatgtagaagaatgggaatactcagcaatatatgatttatttaatgtagaaccttttgaagaaaagggatacgaaattacagaagatttagatgaatataatccaacatatataataagctttaaatatatagaggattatgaacctatgaaagaaaaaattaatgaatgtatttcattaattttacaagaaatgaatgctgtctttgaggcaatcaaaggcaaggaatcagaatacttagagtagttaacagttacaatcaacagttaaaattaagtaggaaatatcccaaggagatttatagtaatataaacaaaactaaagatatttcacagaaatgttaatctgaaatgataattgtacggtgatagctgtaaattgaaaaaaaggggtgtaataaatgagtgaattaaaaaaaagagaagaaatcgatgacaagtataaatggaaaattgataaggtatataaaaatatagctgattgggaaaaagatttcgaagacttaaaaaaagaagctgtaaagctcaaagaatttaatggtaaattaaataatggagaaactattttagaatatttaaaattaaatgaaaaaatatctagaaaagcagaaatactatatatttatgctcatttaaaatgtgatgaagatacatcaaactcaacatttcaaagtttgatgagtaagattgatatttacatggctgaattttctagttatacagcttatttcgtgcctgaaatattaagtcttgaagatggattcattgaaaaagagattgcaagaattgatgagttaaaaccatttaaattcttgtttgatgacatattaaaagagaaaccacatgtattaaccaaagaaatggaagaacttcttgcagcagcatcagattgtcttgatgcaccatcagcaatacacaatattctaactaatgcagatatgacatttggaaagataaaaaatgaagaaggaaatgaagtagaacttacagaaggaaattattcttcattcataagaagcaaagatagaaatgtaagaagagcagcttttgaaaaattatttggtgaatatgataaattcaaaaataccttggctacatctttaacttgctcaataaaaaactttaattttatgagtagagtaagaaaatatgaaagtgcgctggatgcatctttaaaacctaacaatatacctttggaggtttataagaatgctgtaaaggtcatgaatgataatatagagtcacttcatagatatgtttctataaagaaaaaattattaggattagaagaaattcatatgtatgatctttatgttcctgttattgaaacacctaaggaaaaggtggaatttaatgatggcgttaatatagttttagatgcattgaagccattaggagaagaatatttaaatatatttaagagtggaattaatgatggctggattgatatatatgagaataaaggtaaaagaggtggtgcatattcatggggtggatatgacacaatgccatatgtattgttgaattacaacaatgaaatggaggatgtatcaactttagctcatgaaatgggtcattcaattcattcatattactctagaaaagaacagccttattattatgcaggttatacattattttgtgcagaagttgcatcaacaacaaatgaatctttattaattcattatttgataaataaggaaactgatgaaaagaaaaaattattcctaataaatcaagaattagagcagataagaacaactgtattcagacagctaatgtttgctgaatttgaattatatacacatgaaactttagaaaagggtattcctttaacatcagaagattatagtaaagcatggcatgatttaaatgtaaaatattttggtgaagatatggtagttgataaggaaattgatgtggaatggtcaagaataccacatttttattcagatttttatgtttatcaatatgctactggatatgcagcagcgtcagcttttgcaaagtcaatattagaaggaaaagaaaatgcagttgaaaaatataaaggtttcttaaaggcaggaggaagtgattatcctataaatatacttaaaactgctggagtagatatgactacttcaaagcctattgaagctactataaatagatttaatgaattattagatatgatagatattaagtaaaatttaataattttaatgcatactgcatggtacaatataatgtataaatagaaaatatatttatattattatattgtacttttttattaagaataataaatagttattttttataagtgaaagatagtgctgtaaatgataggttattataaaagtgggtgaaagtgtgaataatttttcagatagtttatataaacatctaataaacaatgaaagattttatatgaaacaatattatagtaaatttttttcaaaggaaacatatgtagctgttagggatactgaaggtggattgtattgtgttttaataacagatgatagaaatgaaaatataaacatagtggaggcatcagaatatttaaaaacattaaataaacctttttcgttaaatacagttgtattaacggatgaaagctatataaatagtaatctttataatgtgaataaaattatagtacataagggaaattataatataatgcattttgatgcagcatgtaggcctttagcagggattatacaaaacataggaaaaagaataaaaatgtcgcctagagagattagggaaagatatttaaagtataaaacatcaactttgattattattgcaattaatgtaataatgtttctcataacaagttatatgatttattcaaatctgaatgataacgctatttcctggggaataagtgttaattcaataccagattcggtgaaaaatagggtgagtaatcttgttttgatttttcttggagctaaatatagtcctttaatttatgatggggaaatatggcgtcttatatcctgtgcatttttacatgggagttttctacatatagcctgtaatatgtatatgctttatataataggaccacaaatagaacgaatttatggaaaagtaaaatatatttttatatatttaatatcatgtattacatcaagtacattaagccttataattaatccaaatagtatatctgtaggagcatctggaggtatatttgggcttatgggagcactccttgcctttgcattaatagaaagaaaaaatatagatagagagtatactgtcggcttaataaagacaatagggataaatcttgttataggtcttataatcattaatattgataatgcagcacatattggtggttttttaggaggaataatattaggaagtttattgtataaattcactaaatgtttaaatatatcataaaatcaatttaagttataaaaacgatactttaaataatcattgaaagaaggatctagaatgagagaaagtttggaaaaaaagagcactatgagaaaactaacttatgataattatattacaggtgctttttttgttttacttggaataacattagcatttaatattttttttcaagatggtaataagttatttagaataattcttactgcagtggctgtaataattatgaaagttgtatttacaatatcatttctaaaaaaatctaaggcatcttatactgctacattaacttttattttttttgctatgtatctaggcaatgtttgcaatttttatacgttaataaatcattatgataaaatacttcatctattatcaggaataataataggaataattggtttaataatatatgctcattttacaaaagagtatatgaaaaagttaaatcctaaatttatgattatttttgtatttatattctctgtagctttagctggatgctgggaaatatgggaatttactggggacagactttggggatttcaatctcagaataatagtctagtcgatacgatgacagatataatctgtggaacagtaggaggaattatttcgttatttcctatttatggttttgcaaaaggaaaaaagaatagatttttagaaaaagtaacaaaagaggttatttaatattcaatgaaaaagtacattttattatgaaactaattataaaatgtgcaaataaaagataaatgaaaaagattttacaaaaagactgataaaatgaaaaaataatatggaaattattattattttacggtattataatatatggtaataagtatataagaaataaggagatgtaaaaatgaagggcaatgaatatatttcaagtgttttagaaaaggtagaaaaagttaatccaggtcaaaaagaatttttagatgcggtaacagaagtattaaattctttaacaccagtttttgataagcatcctgaatttatagatgctggattattagaaagaattgttgaaccagaaagacaattaatgtttagagtaccttgggtagatgacagtggaaaagttcatgttaatagaggatttagaattcaatttaacagtgctatagggccatacaaaggtggtttaagattccatccatcagttgacttaagtatagttaaatttttaggttttgaacaaatctttaagaattctttaacaggacttccaattggaggcggtaaaggtggttctgactttgatccaaaaggaaaatcagacaatgaaataatgagattctgccaaagctttatgtcagaattatataaatatataggcggaaatatggatgttccagctggtgatatcggtgtaggtggaagagaaattggatacctttatggatattataaaaaattaagatcattaagtgaccaagcagttttaactggtaagggcttaacttttggaggtagtttgactagaacagaagcaactggatatggtttagtatacttcacagaagaaatgcttaatgataataacgatagcttcaaaaacaagactgtagtaatttcaggttctggtaatgttgctatatatgctacacaaaaagctcaagaattaggtgctaaagtagtagctttatgtgattctaatggatatatatatgataaagacggaataaaattagatatagttaaagaaataaaagaagttaaaagaggaagaataaaggaatatgttgatgctgtaccaacagcagaatatcatgatggttgcaaaggtatttggactattaagtgtgatattgctcttccatgtgcaactcaaggtgaaattgatgaagaaagtgctaagattttagttgctaatggagtaaaagttgtagctgaaggcgcaaatatgccatcaactcttgaagcaataaaagtattccaagataacaaagtattcttcggaccagcaaaagcagcaaatgcaggaggagttgcatgttcagcacttgaaatgtctcaaaatagcatgagattatcatggacatttgaagaagttgatgaaaaacttcatggaataatgagaaacatttaccacaactcaaaaaatgctgcaaaagaatatggcgtagaaggaaatatattagcaggtgctaatatagctggatttatgaaagtagcagaagctatgatggcacaaggaatagtttaataaagtaaaatatagattaatgtacgtataatacatttaaaaagtttaatgcatgatatatttatgcattaaactttttttattatatttaagtttaattttgtttaaatataacttaaatataataaaaatgtaaataaatattatattttaatacattagtaactttagtttcatttttttaatatttatttattaattagtaaaatttaaatattaaaggtgaaaacatattcataacaaggatttatacgttaatttaaaataatggaaaaatattaattttatcgtaataatataggcttgattttttatttctattgaaatatcattaaataggtataatatgaaaacaaatatttaaaaataaattaatgagctgtgctcattaaatattaggagtgaatgtaatgggaaattatatttttaccataacagcagtttttcagatttttgtatttgcgataacatgctattacttaattttgggtgcttttggattagttagaaaaaagaataaaaaagtttatgaacctaaaaataagtttgcattattaattgcggcacatgatgaagaagttgttattggtagccttatagaaagtatgttgcagattgactatcctaaagaattgtatgatgtatttgttattgcggataactgtactgataatacagccaaaatagcacgtgaatatggtgtgaatgtttgtgaaagattctctgaagacaaaaggggtaagggttatgctttagagtggatgtttgacaaattattcaagatggagaataaatatgatgcagtagctatatttgatgcagataatcttgtgcataaagacttcttgagagaaatgaactcaaagatgcaggaaggatataaagtggtacaagggtatattgatagtaagaatccaaatgattcatggattgcagcttgctattctatagcattctggacacagaatagaatgttccaattggcaagagaaaatgtaggattttcaaatcaaataggtggaacaggtttcgtagttgaaacagaaacattaaaagaattaggatggggagctacatgtcttacagaagatcttgaatttacatgtaaacttgtcctaaatggagaaaaagtaggttgggcacatgatgcaataatttatgatgaaaaaccgttaaaacttggtcagtcatggactcaaagaaaaagatggatgcaaggattttccgatgtagcttcaagatatttctttaaattattgaaaaaatcaatagtagaaagaaaattttatgtttttgactgtgctctatatgtactacagccttttgtaacattgttgcttggtatttcagcagtattgacattattgcagtctaatacaaaaggactaaatatatttatagttaattatttatttagtgatattggatttaagatatttgcagttgttcaatttttaataacaccattaatactttcgatagacaaaaaggtttcgaaaggatttatggcaatgatgtgtctatatgcgagtaacgtatttgtagttccgtatttgactactaatgttgatagttggccaattattatagctataacattaggatataatctattattcttattaatgacaggtgtgttcttaggtaagaaaaaccttattttattctttagattcttattatatggaatttatacattaacttggataccaattacagttcaaggtatattgaataaaaataagaaagaatggagccatactaaacacgttagaaaaattgaaatatgtgatgtttaaaaataacttgaatattttcaactagtacttcaaatataacatcgtagaatgattagcattttacgatgtttttttgtggtagcaattagaaaattattttgacaatatttaagaaacacagtatatttttaagagtaataaaatgaaactttttaggtggagcttttactctaactgaacttagtttaatttataaacttaaaatacacaaaagatacattgtttagatgttatcttataattaaaaagcatatattccaaattttttagtgatatgattagttttgaatatttaaggctttgttactgactactagctattggataaaagtagcttatatgagttatactctttttaaagggtataattttgtgaaatagtgtacaattaataatgtatgatgtagaataaaaaaagtatataagatccagttaactgtaaataaacaataaatagaatccttgtctaggatttgaatgtatatgaaaatttgtgattgtgatatattattgcgatacaaatagaactggtgttcagaatggaggaaaaacatggaattaagaaataacaatacttatgatgtaacagatttgacatctcttgaaaaattagagcctgtacgtgtaagaccaggtatgtatattggatctacaggaagcaagggtttacatcactgtatatgggaaataatcgataactccatagatgaaatagcaaatggatatggaaataaagttacaataacattaaatgaagataagagcgttacaataattgataacggtagaggaatacctactggaattcacccaattaagaaaaaatctggggtagaaatggtttatactgaacttcatacaggtgggaaatttgataataaaaattataaaacatcaggaggacttcatggtgttggtgcagctgttgtaaatgcactttcaaaatgggttgaagttgaagtatatcaaaatggaaagatatatagacagagatttgaatatgcttttgataaagaattaaaaagaaacatgcctggtacgccagttactgctcttgaggttataggtaaaactgataaaactggaacaaagataacttttaggccggatgaggagatattttcaacaatagattttaaatttgatataatagacagcagacttcaggagttggcattccaaaataaaggaatacgacttgaattagtagatacaagaaaaggtcaggaagcatcaaaggaatattattcagaaaatggtcttttagattttattaaatacttaaatgaaagtaaaactccattacatgaaattccaataatctttgatggggaaagaacagtaagcaatattcaaatgtatggtgaaatatgtattcaatttactgattcaactacagaatatattgcaagttatgtaaataatattcctactacagaagccggaactcatgaaacaggatttaagactggtatgactagagcttttaaagagtgggcaaagaaacttggtcttgttaaagaaaaagacaaagagttcgaaggtgatgatttaagagaaggtatgacagcaattgtcagaattaaaataaccaatccagtatttgaagggcagacaaagactaaattaggaaatagtgaagcttatacaatgatgaatgatttggtttatactaaattttcagaatggattgaggataataaagagttagctacatttgtaattaacaatgctcttgaagcagcgaaaagaagagataagattaaaaagataaatgatgcagaaagaaagaaaataggaaaaggaacagcaccacttgcaggtaaagttgctgtatgtactatgaaggacaaaactgtaaatgaatttattgtggtggaaggagattcagccggaggttctgcaaagcaggcaagagatagaagatttcaaacaataatgccttcaaagggtaagataatgaatactgaaaagcaaaagcttgaaaatgtattggcatcagaagaattaaagatatttaatacagctgtaggaacaggaactttagataattataaagaagaagatttaaagtatgacaagataataataatgagtgatgctgatgttgatggatatcatataagaacactttggatgacttatatatatagatatatgagacctcttatagctaatggtcatttatatttagctcagccacctttatataaggtatatagagaaacaaaaggaaagagtatagttaaatatgcgtatagtgatgatgatttagacaaggttaagaaagaagtaggaaaaggtgcgttaattcaaagatacaaaggacttggagaaatgaatccggatcagctttgggaaacaactttaaatcctgaaagtagaactcttttaagagtaaatattgaagatgctgcaaaagctgaaaaaatggtgtctcttcttatgggagatgtagtagaaccaagaaaaaactatatgtataaatacggagaattttagttaattgacaattgagaattgacagttgataattttgaaaaaaacagcagagttgtttaaaaatatattatataaagatattccctaggaatatcaacaatcattgttaattgtccattgaaaattgtaaattgaagaaagggcgatattatggcgaagaaaaaagaaaatactattccgaaagataataatatcattggtattcctcttgaagaggcaatgcctgaaaattacttaccatatgcaattgaagttgctaaggaaagagcgcttccggatgtaagagatggacttaagcctgtacatagaagaattttatatggagcacatatgcttaaggcttttccagacagaccttattataagtctgcaagaatagttggggatattttaggtaagtatcacccacatggagattcatctgtatatgaagcgatggtaattttagcacaagatttctccacaaggctgcctttaattgaaggtcatggaaattggggatctatagatggtgatagtgcagcggctatgaggtatacagaagcgagacttgcacctattgcaatggaaatgttaagagatatagataaagatactgttgatatggttccaaactattcagacagtgaaatggaaccaaaggttttaccaagtagatatcccaatcttcttgtaaatggtgcatttggaatagctgtaggacttgctactaatattcctcctcataatttaggagaagtaacagatggcgttttagcttatattgataataatgaaataacaacaaaagagcttatggaacatgtaaaaggtccagacctaccaacgggtggtatattaattggtgaaaaatcattattatctgcttatgaaacaggagaaggaaaggttccatatagagcaaaaacaaatatagaaaaattagaaaatggaagagttggaatagtaattactgagttcccatatagaagaaacaaatccaagatacttcagacaatatctgaaatgactggtgataaaagacatgcaaaggttcttgagggaattactgatataagagatgaatctgatagaaatggaataagagcagtaattgaatttaaaaaatcagttgatgaagataatgcggaaaaaatattaaaatacctgttcaaaaaaacagatttacaatgtaacataagtttcaatatggtagcactatctaatggaaaaccagaaactatgggattaaagacaataattaagcattatgttgaacatcaaaaagaaatagttacaagaagaacgaaaaaagaattagatactgcaacaaagagattccatatagttgaaggatttataaaagctatagacgttttagatgaagttatcgcaacaataagatcttctaattctaaaaagaatgctagtgaaaatttaatagataaatttggatttactgaattacaagcacaggctatattagaacttatgttatatagacttacaggtcttgaaataaaagtgttccaaaaagaatatgcagaacttgaaaaacttataaaaaaacttgaaaaaatactagcaagtgagaaagaacttttaaaagtaataaagactgaattaaaagaagtgtgtgacaaatatgctgatgctagaagaacaacaataatttctgatgatactaagagtaaaatagatgttgaagaattaattgtagttgaagaagttatgattacagtttcaaatgatggtttcataaagagaattccattgaaaaattataatagatcaaattctgatccagatgatattgaatatagagaaggagattatttaaaatacttaataagctccaatactaaagataatcttcttattttcacaaatgcaggatatatgtatcagactaaagggataaatatacctgaattaagatggaaagaaaaaggagaaagacttgatagcgtaattaaatcattaaatcttgatgatgaaaagatagtaggaattatttcgttagataactttactcctggaaaaggatttagatttataacaagtggcggaggaattaaaatcagtggtttagataaattccaaacttcatacactaaacttcaagctttaaaacttagagatacggatgaacttataaatgtttcattaatagatcttgaagatgaaagtaagttcttaaagtttacaactagaaatgagcttgaatttacattagaaataccagaagtagaagatgcaacaagaaatatacttccgactcaattatttaaccttcctgaagatgatattgttgtagatgttaacgatagtgaagaactagaatattttgagcttaatttagggattagtgaaaagggtaaattaaaagcatatggtaaaataaaaccagattatttaaaagttaaaactaagtcaacagaacaattacttatattcaccaatacaggatttatttataaagtacctgtatttatgatgaaaaatatttttacaaaagacatgtctatagatcaatttataggtaagattggtagaaatgaaaaaattataagaatagcttcagttgcttcttatgatgaagatagatgtatttatacatttaccaaaacaggaatggttaagaaaacccttcttaaggagtatgaaggtgaattctttaaacaaccttgtcataaattcaaatatgagtttgatgaacttgtatctgtagatgtagataaaatttcattaggatatttaataatggtgactaaaaaaggaatggcaataagattcccagttgaaaatgttaattctatgggaaaaattgcatctggagttacaggaataagtcttaaggatgatgatgaagttatttatggtaagtattacagtaattatataagtaatggacagaatagcatttctttgaatgaagataatactgaacttattttaacatcaaaaaataaaacaaaaacagaagttcgaataagagatataaagcttcagaatagagcaggtagaggaactagtgtgatgatgcttgttttagatgatgaaataaaagaaataacattatattaaattttttatgattataaaaaattcattaatatttattataatatttggaaattatttattgtttaaagataaaacaatttgtatagaagttaaatattaattgatgtataattaatataatagtagaaagataggatgaggatgttctaatttaagaacatcctcattgttcagattaaggaggtttggttatgaaaaaggtttgtgtactattagcagaaggatttgaagaggttgaggcattgacagtttccgatattatgagaagagcaaaggtagagtgtgatcttgtttctattaaagataaaaaggttacttcaagtcatggcgtttctatagaagctgataaaatatttgatgaaactatggaatatgatttaattgttcttccaggaggaataccaggagcaactaacttaagggatgatgaaagagttataaatattcttaagaaacaaaatagagaaggaaagttaataggcgcaatttgtgcagcaccaatagtccttggaaaagctggtttgactgaaggaagaaagataacttcttatccaggatatgaagatgaacttccaaactgtgattatttagaagatgcagttgttgtagatggaaatatcataacaagcagaggccctgcaactgcaatggtattttcatataaattattagaagttttaggatattctcatgaagttgatggaattgcttcaggaatgttatataaaatgttcatagaaaaataaagtgaaaaaatgtgacctccagagtaatatgctttggaggtattgttatgaaagggaaagttaatggcagaaagatggtttattaagaataaaaaaatggattataaatatatggcacataagtatggaattacagaacttatgagcaaacttataataaatagagatataacagatgattttttgataaaaagctatataaaaccagaatttaatatgcttcatgaacctagagatatgaaggatatgaataaagctgtagaaattattattaataagataaaaaataaaaataaaataagaatcattggtgattatgacgtagatggtgtgataagtgtatatattttatattgtgcacttaaaagatgtggtgcagatgtggattatgaaattccagatagaataaaagatggttatggagttaatgtaggaataatagaaaaggctaaagatgaaggaattgacacaataattacttgtgataatggtatatcagctattgatcctattaaaacagctaaagaattaggtatgactgttatagttacagaccatcacgatataccatttgtggaaaatgaacttggagaaagaacatttataaggtcggaagctgatgcaatattaaatcctaaacaggaagaatgtaaatataagtttaagtctttatgtggagcaggtgttgcgtttaaattaattcaggttttatatgaagaatttaaaattagtgaagaagaggcttttgatttcatagagtttcttgcaatagcaacagtatgtgatgttgttgatcttgtagatgaaaataggatatttgtaaagaaaggtctcgaaaaaataaataaaacaacgaatttagggcttcaggaacttttaattgaatgtgagattcaagataagaaaataggggtgtatcatcttgggtttataataggaccatgtattaatgcatctggaagacttgataatgccaaaaaaggtgtgagacttcttttatgtgaagatgaaaaagaagctgttactttagcaaaagatttagttaagcttaatgaagaaagaaaatcaatgactatgaatggtgttgaagatgccatagaaatagttgaaaactcagatatgaaaaataataaagtatttgtgatatatcttcctcatatacatgaaagccttgctggaataattgcaggtagaataagagaaaaatataatgttccaactttgattcttactaaaagtgaaaatggagcaaagggatctggaagatcaatagaagagtataatatgtttgaagaacttgttaaatgtaaagacttattagataagtttggaggacatccgatggcagctggcttttcacttaaagaagaaaatatagatgagtttagaaaaagacttaatgagaaaactacattaaatgaagaggatttattaagaaaagttacaatagatacagtattgccactagataaaataacatatgatcttgttaatgaattagaacgcttagaaccatttggaaaagcaaattcaaaaccattatttgcggagaaagatataaatgtaattaaagctatgatattaggcaagaatagaaatgtacttaaaatgaaattaaaaactaaagcgggaaaatcaatagatggagtttattttggtgatatagaaacttttgaagaagttataagggataaatatggtaatgatcaacttataaaactttatgatggaagttataatgatgtaaaactagacatggtcttttatccggatataaatgaatataatggaaatgtatcacttcaagttattgtacaaaattatagataaaaatacttaaaccaacaacaatttagtatttattgaattattagaaaaattaaataattgatgataattattatagctagttgtattactagagaaaaattattattcagtatattaatatgtaaatcttgagattattacattatatctacagaagatatttttgagaaagtaataacgaggagataaattcttaatagtatttttttaatatagaaaaatatttaattagattgtatattggaattgataaaaatagataaacaataaaatgatactagaattttggatatatatgtaaaataaataactacaatacatatgtttagtgtaattagttaagaaaagtaatgttgtagattagaaattgtgatatataattaattagaagtggataattaaagaaaggatgattacttttgtataagtacaaaataataatgactggtggaggaacagcaggacatgtaacccccaatcttgcattagtacctaaattgaaagaaaatgattttgaaataaaatatataggaagcaatgatggtatagaaaaggagattataactaaaaataatataccgttttatggaatatcatcaggaaaacttagaagatatttttctatgcagaattttacagatccttttaaggttctaaaaggtgttggtcaatctctgcatatactttcaaaagaaaaaccagatgttattttttctaaaggaggatttgttgcagtaccggttgtgattgcagcttcaattaagagaatacctgttgttgctcatgaatctgatatgactccaggtctggcaaataaacttagtgcacctttttgtgataagttatgcgttacgtttagggaaagtcttaaatatataaaagaggacaaaggaatattaacaggaagtccaataagagaagagatacttaaaggaaataaaaatgaaggtttgaaaatttgtaattttgaaggtgaaaaagaagttttattcataatgggagggagtttaggttctcaactcataaataatgaaataagaaagaatttgaaaaaacttcttgaggactttgatattattcatatatgtggtaaaggaaatattgatgaaagtttggtaaaagaaaaaggatataagcagtttgaatatgtaagtgaggaacttccgcatcttatgaagtgtgcagattatatcatttcaagagcaggagcaaattctatatttgaatttttagctcttaaaaaacctacattactaattcctctttccaaaaaagcaagtagaggtgatcaaattttaaattcaagatcttttgagaaggaaggttactcacttgttattgaagaagaagaattaaagggagatgctttatataataaaatattagaacttaaacataaaaaagatgaattggtaaataatatgaataaggggcaatctactaatggagtggattctatagtaaaaatattacttaacagtataaaaaaataaaaaatataaattatagatttatttcttaaaataacccaaattatgcaatcaaatcttgcaaaaaaaaatatgtgatatataataaaagagtaagttcgttttaggagatgaaaaaaagttaattatttaacaagaagatgaggtgctattaaatgaaaaaagtgtcaatcatttactggagcttaggaggcaatatagaagtccttgcaaatgtgattgcagatagtgcaaaagaacatggagcagaggttattttaaagcatgttgcagatgctgatgttgaagatgtaagaaatgcagatgcggttgcttttggtagtcctgcaaaagattcaactaaaattgaacagagagaaatgcatccgtttattgaaaatttatcagaattgaaatttaaaaataaagaatgtattttatttgcaacctatggatggattgaaaatactttcatggatatatggaagaaagaaatgaaatcatatgggtttaatgtaataggggatttagcagttaaggagtcaccaacaaaagcacagattgaacatgcaaaggaacttggaaagatgcttgcgcaataataaatgtttaaattgagaagtggagtctaaattaaatgtttaaattactagagaggtattttgaagttcaatatatctatgtttttgatggatttaactgagtataaatctttataattaatatgttattaggtggtctttataagacttacttatataaaaattaaacttaaattataaattaagttttaaaaatagaaagaggggtcaacgcgatgagaaaaatgaaaactatggatggtaatactgcagcagctcacgtatcttatgcatttactgaagttactgcaatctatcctatcacaccatcatcaccaatggcagaacatgttgatgaatgggtagcacaaggtagaaagaacatatttggacaaccagtaaaggttatggaaatgcaatcagaagcaggtgctgctggtgctgttcacggatctttacaagctggagcattaacaactacttatactgcttcacaaggtttattattaatgataccaaacatgtacaaaatttctggtgaaatgttaccaggtgtattccacgtatcagctagagcattagctacatcatcattaaatatctttggagatcaccaagacgttatggcagcaagacaaactggttttgctatgcttgctgaaggttctgtacaagaagttatggatttatcagcagttgcgcatctttcagcaattaaagctaaaattccattcttaaacttctttgatggtttcagaacttctcacgaaattcaaaaaattgaagtacttgaatatgatgaattagctaagttagtagactgggatgcaattaaatctttcaaagcaaatgcattaaacccagatcatcctgtaacaagaggaactgctcaaaatgcagatatatacttccaagaaagagaatcagttaataaattctacgatcaacttccagaagttgttgaaggatacatgaatgaaatcaacaaattaactggtagagaataccactgtttcgattactatggtgcagaagatgcagatagagtaatcgtagctatgggttctgtaacagatgtttgtgaagaaactatagattatttaaatgctaatggacaaaaagttggtgttgtaaaagtaagattatacagaccattctcaaatgaaagattattagcagctattccaaaaacagctaagaaaattgctgtattagataaaactaaagaaccaggatgtgctggtgaaccattattcttagacgtaagaaatgcattctacggacaagctgacgctccagtagttgttggtggtagattcggtttaggttctaaggatccaaatccaagtcatattgctgcagtttatgaaaacttagcaaaagatgaaccaaagaacggattcactataggtatagttgatgacgttacaaacacttctttagaagtacatgaagatatcgatgctactccagaaggaactacagcttgtaagttctggggattaggatcagacggtactgttggtgctaacaagagtgctattaagattatcggagatcatacagacatgtttgctcaaggatacttcttctatgattctaaaaaatcaggtggtatcactgtatctcatttaagatttggtaagaaagaaattaaatctccttacttaatcaataaagcagatttcgtatcttgctcaaatcaatcatatgttcataaatataatgtattagatggattaaaaccaggttcaactttcttattaaatactatctggactgcagaagatttagaaagagaattacctgcttcatataagagattcatagctaacaataacattaagttctatactttaaatgctgtagctattgctcaagaaattggtcttggtggaagaattaacatgatcatgcaatctgcattcttcaagttagctaatataattccactagaagatgctattaaatacttaaaggatgctgttgtaacttcttacggtaagaagggtgaaaaagtagttaacatgaataacgcagcaatcgataagggtgttgaatcagttgtagaagtacaaattccagaagcttggaaaactgtacaagatgaagaagcagctccaatcaagggtgctactaaattcgttaaagatatagttattccaatgaacagattagaaggagataaccttcctgtatctgcatttgtaggaatggaagatggtacattcgaagctggtactgctgctttcgaaaagagaggaattgcagttaatgttcctgaatgggattcagctaaatgtattcaatgtaaccaatgtgctttagtatgtccacatgcagctataagaccaatcttagttaatgaagatgaaaaagctaaggctccagcttcagctaagatagttgatgctaaggcattaaagagcgaagaaaagttatattattctatggctgtaacaccacttgactgttcaggttgtggaaactgtgctcaaatttgtccagcaccaggaaaagctttagttatgaaaccacaagcttctcaagaagaccaaaatgaagcatgggattacttagttaacgatgtaactgctaagaagaacccaatgaacaagaatacagttaaaggtagccaatttgaacaaccattacttgagttctctggagcttgtgcaggttgtggagaaactccatatgctaagcttataactcaattatttggtgatagaatgatggttgctaatgcaacaggatgttcatcaatttggggtggatcagctccttcaactccatacactaagaataagaatggacatggtccagcttgggctaactcattattcgaagataatgctgaatatggattaggtatgttcttaggagttaaagctcaaagagaagaaattgctgaattagcaaaagctgctattgaagcaaatgatccagctaaggctgaattacaagtttggttagataacattgacgaaggtgctaacactagagaaatcgcatctaacttagttactgctcttgaaaaatcaggaacagatgctgctaaagctatcttagaaaagaaagaatacttcgttaagagatctcaatggatctttggaggagacggttgggcttacgatatcggatacggcggtgttgaccacgttcttgcttcaggcgaagatgtaaatatatttgtatttgatacagaagtttactcaaatacaggtggacaatcttctaaatctacaccaacagctgcaatcgctaagtttgctgcatctggtaagaagactaagaagaaagatcttggtatgatggctatgacttatggctatgtatatgtagcacaagttaatatgggtgctgataagaaccaagttcttaaagcaattgcagaagcagaagcttataaaggaccatcattaataattggatacgctccatgtatcaaccacggtatcagaattggtatgggtaacagtccagaagaagctaagagagcaactgcttgtggatactggcaaatgtacagatacaacccaacaatggttggaactgataagaacccatttgttcttgattctaaagaaccaacagctgactttaaggaattcttaatgggagaagttagatacgcttcacttgctaaagcattcccagaagctgcagaagcattgtttgaaaagactcatgcagatgctatggctagattagaaggatacaagaaacttgctaatcaacaataatctttaaaatttaattaacttaatttgcgcgtagtttaattagatagatcgccttgtggaagaaattctgcagggcggtcttttttagttaacagttaacaagtaacagttaacagttgaaggaagaaatctccttaggagatttcttagaatatagaaataaagatattttgaagcaatatcaacaataattgttaactgataactgttaactgataactttttttaactttgggcttttaatttttgtgatttaagggtaaaatgaatacaagaaccaaaaggaggttgaataatggataaagatttagaaaaatgcggatgcggttcagactgtggatgcggagaaaacaaccatgaatgcggatgcggtggacatgatcacgatgactgcggatgtggatgcggagaacatgaaagcttcgttattgatttagaagatgaaaacggagatgttatcacatgtccaataatagatgaattcgaatgcgaagataatcaatattatttagctcaaaatccaactgaggattctgtttacttattcaaattagtaggggaagaattaatagtacctgaagaagatgaatttgaaagagtttcagcttactaccaagacgaattagtaggcgaataagataatttaggctttgaaggtatcatactttcaaggcctttttaattgttcagcaaattataatgcagtgaaattgttgataactttgcaatgttaaaaacgtgtattagtaaattaacagattcaaataataaatgtagcctgcaaaataacctaaaaacgagttttggaatatttgcatggataaaaaaatttttatgattttaactttgaattaacagctatgaactatatttacattggttagcaataatgatatatttttaatgtatagaaattgcaaaacaggaaataaaaatgttgtgagattgatatattgtacagagtacattttcaattgaagataaggtatggaaagaaaataatgagacggaataatctattattttttgataatgcctaagtacataataatttgcatatataaattggagggaataagcaatgaatttatcaaagaaggcgggaaatataagtccatcaataacactatcaattacagcaaaggctaatgaattaaaagcacaaggtgtagatgttgttagttttggggctggagaaccagattttaatacaccacaaaatataattaatgcagcaattaaggctatgcaagatggaaaaactaagtatactcctgcaggtggtattttagaattaaaaaagacaatttgtaaaaagttcaaggaagataatgggctagattatacaactgatcagataacaatttctactggagcaaagcaatgtcttgctaatgtttttatggcaattttaaatcctggagatgaaattttaatacctattccatattgggtgagttatcctgaattagttaaacttgcagatggggttccggtttttgttgaaacgttaaaagaaaataattataaatatacaatagaggatcttgaaaaggctgtttcagataaaactaaggctatattaataaacagtcctaataatccaactggaactatttataatagagaagaattaattgaaattgcagagtttgctaagaaacatgatttattaattatatcagatgaaatatatgaaaaattaatttatgatggagaaaagcatataagtattgcatccttaagtgaagatgcatttgaaagaacagttgtaattaatggtgtgtctaagacatatgcaatgacaggatggagacttggatatatggctgcatctaaggagattacaaagttaatgacaagtattcaaagtcatatgacatcaaatgtgaataccatagctcaatatgctgccatagaagctttaaatggaccaatagaagatttaaatactatggttaaagaatttgaaagaagaagaaactttatggtagatagattgagtaaaatagatggtgtttcaattataaaaccaagtggtgcattttatattatggttaatatttcatcatattttaacactacatttaaaggggaagaaataaaaaattcgttagatttttctagagtacttctagatgaagaaaaggtagctgttataccaggggcaggatttggccttgatgaatatataagattatcatatgctacatctatggatataatagaaacaggtatagatagaatagcgatgtttatcaataaaataaaataatgaaaatagggggcttgcatatttgttatatgtaagtcctattatatgtaacaattgatgttttataatttaaagttaattataaaattttaattgataaagttaaactagtaaaatataaggtttatagttttacatttgaatctaaattatagataaaggtggaataatgtgttgaagaaattagctatatttgatatagattatacaattactagaaaagaaaccctgatggagctatttaagtatactattaagaatgataaaaaaaacttaaaattcttacctagggcagcttattgtggcttgatgtatcttatgaagttttatgatgaaaaaaaagtaaaagaaacatttctcaaatttatagataagatagaagaaaaagatttagcgttacttgttaagaatttttataatgatagactgcagaatatactttataaagatgctcttaatatgatgaaagacttgaaaagtaaaggatacgatatttatcttatatcggcatcgcctgaattttatgttaatgaattttatgccattaaagaagtggataaaatttttggcacaaaatttaagtttgaaaatggagcttttttaagacaaatggatggagaaaactgtaagggagaggaaaaggtaaaaagattaaaatcatatcttgatgaaaataatatagaagtggattttaaagaatcatatatgttttctgattcattgtcagataaacctttgttagatatggtaggaaaaccatatttaataaattataaaaatggtcataaaaatatagaaatattaaaatggaattaggcatataaaagaaaataacaagtttaaatatgctgagaatattttttggcaaacaagaaaagaaagtagattattctcatatcttgctattaggcatagctactgatatgttatgttagataataggagttaggagaatataagtgttatttttttataatgtcttagaaagggatgtaataatattatggaagaaagagttatttatgaggttttgagaattattgatggtaagccaatatttttagaagagcatgttaaaagaatggaaaattcttttatgattgtaggtaaagaatttccgttaaaatatgaagatatttatatgagtatagatagtaccgttaaaagtgaaaataaaatgataggtaatataaagataacttactgtttgaattcaggagagttaaaagtattttttattccccattcataccctactgatgaaatgtatagaaaaggagtaaaaactattttgtattttggagaaagaaataatcctaatgctaaaattataaatgatgattttagaagtaaggttactgcagaaataaataaaaataatgcctatgaagctatacttgtagatagaaatggatttattacagagggaagtaagtctaatatatttatgataaaaggagatgaattgattacttcacctattaaagctgttctacctggagtcactagaggaaaaataatagaaattgcacatagtgttggtataaaagttatagaagaagaatttagctataaaaatattgataaattagatgggatgtttatatcaggaacttcaccagagattcttccaataaatgctgttggtgaaataacattaaatccagaaaataatattattaaaatattatcagaagaataccataaagaaattaaaaaatatctataaaatactatcataaggtaccataaaaatgtaaaaactcatataaaattgtatcaccctgtggtatactaaaagtaataagtatttttatgggggattagttatgaatttgatattttccgcaggcagtattgatgaatgcttggaaaaagcatcagatacactaaagataaataaaaatgatttaaaatataagattattaaagaagaaagaaaattctttagaaaaaaataacgatagaaattgaaaacaaggatttagaagataataataaagaagatagtttcaggcaagatactacaaatagatttggtgcacaagttaaagatgggaagataatagtaactccatttgataatgatgaaagtattacaattaaaggctgtgaaggagtacgcttaattttaaatggtgaagaaacaaatattattgagggtgctaaaattactgataatattgagtatgtaattgaagaaagccaacaagcagaaagaactatggaaatttcggtttccaaaaataaaatggaagcatacctttcgattaaatcggtaccacaaaaaatatataaattggaagattgtgaaccaagaaaaaatttagttctaaaaagagttttagttgaaaagaaatatgcaccacaatatacaccggaagatataaggaatgctttgaaagaaaaaaatgtagtatttggtgtgcttgatgatgttctgaaaagaatctgtgatagtgaagaggttatttgtgaagtggtagctaaaggtgtacaagctattgaccctaggccagaaagtatggatatattatttaaagattatgatcaacttaaagaaaatattgataccgaggttaaagttgattatagaaatagatttatgcttgctagtgttaaaactggtgaggaaatagcaagaataataccttctaaaccaggaaaagatggcaaagatgtatatggaaacgatgttaaacataaagaagcttcacgtataaaatttaaaattggtgaaggttgtaagtgtgaagacaataaaatactagcgacaatagaagggaaaccttcatttagagataatatatttaaggttcatcaggtctatgaagtagaggatgttgatttgagcactggaaatataaattttgtatcagatgtacgaatttctaaaactgtatatgaaggtatggaagtagtttctggaaatacaatctttgttggaaagaatgtagaatctgctaaaattacagcagcaagcaatattaaaatacaaggtaatataattaattcaacagtagttgctggagattacagctttaagaaaaagaagtacctattgaatttaaatgatgcaaggaatatgatacgtgaattacactctgctataatacagataaatagtaatagtatacttgaaggacgaaaagttggtgaacttataaaattattaattgagaataagtataaagccttaatccccttgtgcgaagatataatagaatattgttctattcaaggggtgtatgattcaccagtgacatcttttataaataataaaataaaaggatttggtccattaaatataatttgtgaagatgaactgcttgattttattgacatattaagtgaagaatgtgatgaattagaatcatttgaagcaaatgatgcggatatagatacggaatatatacaagcatcaaaactagatgcgttaggaagtatatttattcatggaaaaggtcaatataattcggaaattacagctttaaagaatattgagtttctacaggaaaaatcagtctgtagagggggcgtaatttcagcaggaaaagaaataaaattaaagacagttggaagtgaagctggagtgaatacaatacttaaagtacctaaagatggtgttattacagctgatatagcatatagtaatacagtattttgtattggtgagaagcaaattatgctggatgtttcgtctaaaaatgttaaggcatatatggataaaatgggagacatagaaattgataagttacttttataggaggatatagtagatggcattagataacagtaagataatcatttttgaattaaatggagagcgctatgcagcagatataaaggaagttgagaggatacttggatatgaagaacctacagttcttccagaagcgcctcattttgttaaaggggttataaatcatgaagagaaaattcttccgattataagcttatctaaaaagtttaatattgatgaaggaactaattatgaatctaaaaaaataatagtagtcaaaagaaaagaaaagaaatttggtataattgtagataatgtttatgaagtgagagatattgatggaggatgcatagaaaatgctcctgaaataactaatacatcagaacgaagatatataagtggacttattaagcttaaaaataatatagtaatacttctcgatttagaaaagatattatctatagaggatgaagatagtatcttttagggggtaaagatggggaataatgagattaaagttggcatagctgatttaaatttagttcttgatccaggaacaataatgactataggccttggatcatgtataggaattgctttatatgatagatctttaaaagtagcaggtttatctcatataatgttgccagatagcacacagtttaaaaatgcaagcaatcctatgaaatttgcagattcagcgattcctatacttattgataaaatgtataaacaaggatgtaaaaaacaaaatattatcgcaaagattgcaggtggtgcatccatgtttaattttagtgataaaagtataataagtgatataggtaagagaaatagtgaagctgttaaaaaagtgcttaaagatttatccatacctataatagctgaagatacaggaggagacaaaggaaggactatgatattggaagcaagtactggaaaagtaacgcttaaaattgttggtaaaggtatgattgaactttagtgaggtgataggatggaaaaagttagagttatagtagttgatgattccgcttttatgagaaaggctatatcagatatgatagagtcttgtgcggattttgaagtaattgcaaaatttagagatggacgagaactggttgaaaaagttgataagtttaatccagacctaatcactttagatgtacatatgagggatttagatggacttgcaactttaaaagaattgaagagaatgggcaagaattatcctataattatgcttagtagtgctacaacagaaggttcagagcttacattagaatgtttagacaatggagcaattacatttattacgaagccgtctggaagtatttcattagatatcgataaggttaaagaacgattaatagatgaaataaaaggtataacaagcaatataagggttaataagtcgtcaaatatacatatgaggcaaattacctctaataaagaattagaaattgaaaataagataaaagatagacgtgttaatgctcagctttctcaaaggaaagagattaacaatagtgaaaaaccatcaccaatgattaataacaaggttattcctaaaaataaaaaaattgatgcagttgttattggtgcatcaacaggaggtcctaaagcacttcaacaagtacttacaaagcttccggcaaatttaaatgttccggtatttgttgttcaacatatgccagaaggttttacaaaagtgtttgcagaaaggcttaacaaagtttgtaatctaaatgtgacagaagctgaagatggtatgagtataaatagaaatacaatttatatagcaaaaggtggaagccatatgataattgattcgtcaattagagtatcattaaataaagaaccatcaatatggggagtaagaccagctgtagataaactttttgaatctgcatctaaagtatatggtggtaatttgttatcagtagtattaattggtatgggtaaggatggagccgaaggaagcaagagaataaaagattgtggagggataacaatatcagaagataaatctacatgcacaatttatggaatgccaaaggcagcatatgaaacaggtaaaattgatttagttcttcctcttgatcagatatgtaataaaataaccgaaatagtaaaagggatataggagaaaaatatggattttaatgaatttcatagatgggtacacagagagctgggaattaatttatgtgcttataagcctgaacagcttaatagaagaataaatagtttaatgacaagagtgggaatcaaatcattagacgaatatacaaaagttataaaaacagattctgagcaaaggcagaagtttcttgattttataactataaatgtaacagaattttttagaaatcctgaattatattcagaactagaaaataaagttaagtctgaattactaactaaaggtcaaaatcttaaagtatggagtgctgcatgttcaattgggtgtgaaccatatacactagcaataatattggatagaatatctcctactggaagacataatattatagcaactgatatagataatactatattaacaaaagctaaaattggggaatatacaaaaaatgaaatgaaagctgtatcaaattcagatttgagtaaatattttgatataagagacgataaatattatgtaaactcaaaaattaaagataaagtgacatttaaaaagcatgacctaatcttagataggtatgataaagattttgatcttattgtatgtaggaatgttgttatttattttaataatgatgttaaacaggaaatttataaaaaatttagtgaatcattaaaaaaaggtggtcttttatttgtaggagctacagagagtatttataactatagagactatggatttgaaaaagcatcaacctttatttataaaaagatataattttattaaaaaggtataaaggaggaataagtgatggatacatctcaatatatgtcaatgtttttagaggaatctttagacaatttacagaccttaaatgaatctcttttagagttagagcaaaatccagaagatgtagacaaggttaatgaaatattcagagttgcgcatacaattaaaggtatggcagctacaatgggatttaatgatcttgctgaattaacacataaaatggaagatgttttatcagaatttagagaaggcgaattaaaagttactcaagatgttgtaactgtattatttgattgccttgatacattagaaaaaatggtagaccttgttcaagaaggttcagatgaaaaagttgatattgaaagtattatggctaaattagcatatataaaagaaaatggaaataaaaatcaacaagaaaacattccagaagaatctaacagtgctgaagtaaaggtatcacacaatgattcaataggattagacttaaatgaatatgatatatcagttataaagcaagcccatgaaaaagggtttaatgctgtagaaattaaagtgacattgagtgaaaatacacttcttaaatctgcaagagcatttttaattgttaaagatcttgaagatcatggtgaaatcttaaaatcagttccttcaactcaagatattgaaaatgaagaatttgatttagaattaaaatttgtattgataacaaaaaatactgttgatgaaattctttctatagtaaatggaatttcagaggttgttaaggttgaagcatcagcaattgaaatagaagaaacagaaacagtggaagtagaaaaggtagaagaagttaagcctaaagaagttgaagaaaaggctgaagaatcaaaaaaaatagaaaacgtagtagaagcaccaaagaaagcagctacaaagaagccacaacctaaaaaagaagttaaaaaggcacatcaatctgttagagttgatcttgaaagaatagataatcttatgaatatggtttctgaacttgttatttatagaacaagacttgaacagatagtaactacacataaatcacaggaattaaatgaaacgttagaacaagttggaagaacaacttcagatttacaagatcttgtaatgaagataagaatgcttccattagatacagtattcaatagattcccaagaatgataagagatgtatcagtagaattaaataaagaaattaatttcataattgaaggtgcagatactgaacttgatagaacagtaattgatgaaattggagaaccattaatacatttattgagaaacgccgcagatcatggtattgaatctaaagaagaaagaatagctgctggtaaatcaccagttggtacaataaaacttgttgcatatcaagaaggtacaaaggcattaattaaggtaattgatgatggttcaggaataaatgttgaaaaggtaagagcaaaagcagaacaaaagggaattaatacagaaggtttatctgaatctgatattaagaatttaatatttgctcaaggatttagtactaatgaagttgtaacagatctttcaggtagaggcgttggaatggatgttgttaaaacaaagatttcagcacttgggggtactgttgatgtaataagtgaagaaggtaaaggatcaacatttatcataaaacttcctcttacacttcaaataatacaagcattacttgttaaagtaggagaagaaacacttgctatatcattaggttttattgatagagttatagattataaagaagaaaatatcaagaagagtaatggtaaagaagtaattgtttatagagaagatgtaattccgttagtaagattaaatgaaagtttagatatagagtctagtaaaactgataagaagtttgttataatagttaatgtaggtgacaagactataggattactggtagatgcattatgtggacaacaagaaattgtaattaagccactaggaaagacattaaaaggattagatcagtatattggagcgacaatactaggtaatggactagtaacactaatattagatattggagcactattataaggtgaaacttttcagaattagttttatgctgctgaatttagttgaacttatccaaaagtgagttgcagccgttatctgtcatttaaagacaagcatatattccaaattttatatttggaataattactgtcatatagtggtggagagtaatgcggatgccatctattggataaaaatacttttaagaggaggggtattttatggactactcaagcttaagtatgatacaattagatgcgttaaaagaagtatcaaatataggtgcgggaaatgccgcaacagcactttcaatgttattgagtaaaaagatagatatgtctgtaccatcagtgaatgtggtaagattagaagatgttgttgaagaaactggagagtctgaagtttctggaacagtcgtaagggttttaggagatattgcaggaaatatccttttggtctttaaagaggatactgttaataagataatcgggaagttagtgggaactaatgaaggcataaatagtgaaatgggtcaatctgttttgtgtgaaattgccaacataatttctgcttcatatatgaattctattgcacagttgactaaccttgcaattgcaccatcagttccggcggtagcatatgatatgttaggtgctatacttacaacgacttttatagagtcaaatcaatatgatgaatatatattagatattgagactatatttttagatgaaacagaagaaaatataggcggacacttttactatatccctatgccgggatcattagaaaaaatattaaaatcaataggaataagttaatttggagggaaaaaaatggctaaagttttaattgtggatgatgcagcatttatgagaatgatgataaaggatatcttggaaaagaatgattttgaaattgtaggagaagcaaacaatggtattgttgccgttgatatgtataagaaggaaaaaccagatgtagtaacaatggatataacaatgccagatatggatggtattgaagctgttaaacaaatcaaggcatttgatccaaatgcaaaaattataatgtgttcagcaatgggacaacaatcaatggttatggatgctataagagcaggagctaaagattttatagtaaaaccattccaagctgaaagagttttagaagctattaagaaagttataggttaatatttatttaatcaatagttggcagttaacaagtaataatcattacataagtatagaagagttaactgctgacttgttgtgattagatttttagtataaatataatgggtaaaggagggttacaatgatgcaaatagtagtatttaaattaggagatgaacatttcgcagttgaaacagatagagttcaaagtataaatgatattatgagcataactaaggtgccaaaggctccaagctatattaaaggattaataaatttaagaggaagcataaaatcattggtagatttaaatttattattagatgtaaatcatggaaatgaacaaaatagtataataatattaactgttgaagatgaagaaattggaatatctgttgatgaagttgaagaagtattggatatagatgaaaagaatatacaaaaattagataaggataatgataaagctcaaccttatattaaaggtatattaaactatgaggataaacttttaactataatagatatagataaactactaaactaattgaaatgagggaggaatatggcagacgttttatcacaaaatgaaatagatgccttgttatctgccctgtctacaggtgagcttgagccagaagaagttggtaatgatgaggagaaacataaagtaaaactttatgattttagaagtcctcagaagttttcgaaggaacatataagaactttagaattagttcatgataattatgcgagaattatttctaattacttaactggtcaaactagacaaaatgtaaaagttaaaatagaaactgtagagcagataacttatgaggaatttatacattctgtacaaaaccctactattataacagttttcaaaatgcctccacttgcaggcaatataatctttgaaactaatcctcagttttcacttcaagtaatagatatattattaggtggaaatggagataggaaggttgaagcaaaagaattctcagatattgataaaaatatcatgagacagataactagtggaatgataagtaatttgaaattggcatgggaatcaattttagaggttgaacctgaggttgaagggattgaaacaaatcctgcaattaatcagacattagcgcctaatgaccctgtagctttgattacattttcagtagaaatgaataagcgtagtacgtttattaacatgtgtattccatatttgagtatcgaaaaaatattggataagttagttgttcaatattcttttaaaaatgatgatgaaagtttaaaagcggaatcaagagaaaaaatagaagaaggcatacataaagtagatgttgatgttatagcggaacttggaaaaacaagtttaactgtagaagatttcttgaaattaaatgtaggtgatgtaattaagcttgatacaaggagctcatccccagtaaaagtgtatgtaggaaatgaagaatgttattgtgctaagccaggaatatcaggaaaaaatatgggtgtaatgatattagatataacagataaggaagtgaatgggtatgagcaataattttttatctcaagaggaaattaatgcattattatcaggtgaatctacagattcagaagataacaatgtatcttctgaagttaattaagacatggaagatgcaattactgaaacagataaagatttattaggagaaatagggaatatttcaatgggatctgcttctactgcattataccagcttataaatcagcaggttaatataacgacgccagtagtatcagtaacaacattgaaagaaataaaagaaggatttgaaacaccaaatatagtgcttgatattgaatatatagcaggtatagttggaagaaatatattaattataaaaacatatgatggtcttgtgatttccaatcttatgatgggtggagatggaaaagtaacagatgttcatgaattatctgaacttgaaataagtgcagtttcagaagctatgaatcaaatgataggttctgcagcaacatctatggctactatgtttggcagaaaagttgatatatcgcctcctacatcaaaagtagtaacagatgatttaatgccgatatctgattcaataccagaagatcaacctatagttaaggtttcgtttaaaatgacaattggagatattgttgatagtaatataatgcagatttttccgatagaaactgctaaaaatattgttgcaataatgacaggagaagattcagcaaataagactagtgaatcacaacctgaaaagccaaaagaagaaccgattgtcaataaagaaatacatactcagccagagccacagatgcaacagaatgtatcagaacctcaaatgcagtatgaacaaccacaaatgcagatgcaacagcaacaatatgttccacaacaacagatgcaaggatatggtcagccacagatgcagtcgtatatgcagcaaccacagatgtatggtggaggtcaagttcaacaatatgctcagcctgtggaagtgcatcaagcagcatttgagccattaacaccacaaaatagtgttccaccaataaagaatatagatttaataatggatgttcctttagatatatctgtagttcttggaagaactaaaaaaagtattcaagatatattaaatcttggtgcaggatctttaatagagcttgataaacttgctgaagaaccagtagaaatacttgttaatggaaagcaaatagcacttggagaagttgttgttgttgatgaaaactttggtgtgagaataacaagtattgtaagtaatgttgaaagacttaaatctttaaaataaaatatatatttcaattaacaattaatttagaaatcactatgtgatttcttgattgtaattgtaaagtttatagtgactgtgtggtttttatacagtcgctttttctatgtagtaattcatggtattatataaatttgagtattggaaatattgtgttattcaagtgaaggatgtcagttatagataagtataaaactccaatcgaatttagcgaaactttatattgtaatgatattatacatatgataaaacaattctacaaatgattgtgaggtgagttttgtggaagaaaagatttttcaaatattgcagaatatacaaagtgacataagttccataaatataagaataggttcattaactgttatgaaatagtaagattaaaagctattaaatagtagtgatattttttattaatagtatattattttgagagaatagattaggtctctctttttttgtctaaaaataatatttttaagattgtatttgatatatatagttaaaaatgtgcataataattacattggttatattagaaagaaataacacgagaatagctataaactaaattaatttgtgttcgataaatatattaatagataaaggcacaatcaaataaataacaagttcataacaattttatatttgttatttatttttaggtacctaagaatggagtaatggttatgagtatagatagaattaacaggcaatcttttataaatgcatataattcaaattcaaataaatgtgttaaaaatgttactaaagcaaaaacttttgatacaatagagatttcatctttaggtaaaagtttaaaagattattcttcagataataatattgataatgcaaaaaaagtggcagaaattaaaaataaagttgatagtggaacttatagcattgatgcaaggctgacagctagaagtatacttaaggctatgaaaggagaataatttatatatatggtaaatgatttaattggattgatgaaggaacagaaagcacatttagatcagcttttagttctccttcaagtacagaaagaaatgataatgaaaaaagatgcatttggtttagaaggcttagttaataaattaagtgattgtagtaaaaaaattgctcaggaagaagtagctagaagaaagatgcttaataatagcagtattaaagagtttgtaagtaatgcaaaaaacaaagaacttacagaaatttatagtgagttgtcaagtactcttgaaaaagttatttttcaaaaagaaactaatgaattattaattaaacaacaggttagtttgaattcaaagatattagagatgatgaatcctaatagagatatgaaaacatataattcttatggaaatctatcaagatagataaatttcaatgtacaattgacaatgtaaattctatatttagaagtaaagaagtcaacaaattacattttgttcagccaatgtactctaatgaagagtacattgtgaactgtgtattgaaaatagaataatatggaagttgaatatataacaaggaagtagaatgaaagtagggagataaatggcaggattgtttgatacttttacaatctcaaaaagagggttaagtgtacaacaaggaaatattaatacaactgcacataatatagcgaatgcaagtacggttggttattcaagacaaagggctgttgttgaaacaacaagaccttttggaggaaatggaaaatgggataactgttcagctggacaagttgggacaggtgctcagataacaactattcaaagaataagaaatgaatttatagattatcagtatagagatgccaatagtatacttggtaattcacaagtgaaatcagagttcttaagtaagattgaagatattcttggagaaacttcagatactggtattcaaggtcttatgagtgaattttataaatcacttcaatctttaactagctcatctgataaaactgatgtaaaaagtgtagttcttcaaaatgccttagcattaacagatgcaataaattatacatacaatcaattagaaaaacagctaggaaatgcacaggatcttttgggagataatgtatcagagataaatggatatttagatcagataaatgaattaaacaaacaaatagcaagagttactactatgggacaatctcctaacgatttaatggattctagagatgctcttttagatgaattaagttcgaaatttggatttaatattgataaacaagctctaaatgcaattgatattaattcagatgagtacgataatttaaaattagttaatgcaaatccaaatgatttagactataacagattttctacagttaagtcggcagatgtagttgaaaataaagatggcacatattccttaaatattgagtattacaaacttggagatacgaattcacagccagttagcataacattatctggagagaaagatactcttaatagtttaaaagatgaacttactacatgtagggttctaataacagataaagatggtaatttcaaagtcaatggaacaaaagtagaaccagggacaacttttgctataactgatgctaatttaaatgattttaagaagaatatattcaaaacttatgaacatgaagctggtgtgaataatgtacctataagtaacgataaaataaaaggtgaaattgcaggaaatcaatctgtacaagctactattaaagggtatatgaatgacttagacaagcttgctgctggtgtggcttatgcaatgaatgccgttcaaacaggaagtcttgatggaactaatactgtttctgatacgcttatctttgtagctagtggtacaaaatcagatgataagataactgcaaaaaatataactattaacaaggatattttagataatccgtcattattaaattgtaaaccagccaatgaatctggagatggagctaatgatagagctatagctatggcgactctaaatacattgaaatttaatttttcaaatgtttcgggtgattcttcaacctggacaagagaaagcttcttaaatgcagcgggtgttagtttttcaaacacatctggaaatcccgaagaaaatattaatttatcaggagattcgtctggatcaacaatggtaagtcattatgctggaataataagtaaattaggtagtgcatcaaaagcagctagtaacacagtaactaatcaagaaacggtacttcaaggattagaaaatcagagaatgtcagaatcaggagtatctttagatgaagaaatgacagatataattacattccagcatgcttatcaagctaatgcaaaaatgatatctactatcgatgaattattagatgttgtaataaacggattaaagagataaataaagaggtgaaaagatgagaataacaagttctatgctatcttcaaattatttaaaaaatgtcagtaaaaatatgaattatattcaaagattacaaagtcaattatccacaggaaaagaaataagtaagccatcagatgatccttataaagcatctagaatagtaaagatgtatgcagatatatcaagtaatgaacaatataatgataatataactgatgttactaattttcttgatgtaacagatacttcaataacacagataagtaatttatattcaagagtaagagagttattagtatcagcaggtaatgctgcctatggatctgagcagatgcagtcaattcaagatgaaatgaaagtaaaagttaatcaattagctcagcttttaaatacaagttttgatgggaaatatgtattcggtggaactaaagttgattcgagtccggttactgtagtagatggaaaaatacaatatgctgatgcagatggaaaagctattttaatatataaagatgcagatggaaagcttacaacatctaaatctacagataatactgctaaaacattaacagatgcaggtaatactactgggaaaaatgttgaagatgaattaaaggaagaattagcagggttaggagctgatgattcagaaagaaaaagtgaaattgaatcaatgcttgatggaagcaaggaaatatataaaactaaagatggaaagtatacgacttctaaaagtcaagaaaatactcaagttaatatagctaatgtcaacagaagtgaaattgaagatgaaatttctaaattagatgctgataatgatggtgttgcagatgatgcagctaatgctgatagattaaaagagttaaatgatattaagcaaggaataattaattataatcaaattgatgcagatatgaaaatcgaaatatctcaaggagtaatcattgattataataaaacagcttctgaaattttagagtttaaagatccagaagatccaacaagaactattaatgttgctgatttatttaataacatcatagacaatttgaatagtgaagatggaaaagatgctttaacaggagaaaatttagcttatttagataaagcaatttcaaatcttttaacaaagagttcagaagttggtgctatgcagaatagaatggaaagtgcaaaaactcaaaatgaaacggaaaatgataacttaacagcaatattatcaaatgttgaagatatagattttactgaaaagatgattgatttttcaacgcttatgactgtatataaagcatcacttcaaattagtgctaatatactccctaagacaataatggattatttataagataaatttaatttagaagtgtaggggagtagttaatatggaatttatatcaaaagttcatggggaaataaattatgatgaaaaagacattataaaattcagtaagggaataccaggtttttgtgaattaagggaatttgttattgttgaactaaaggaatatgagccatttaaattgcttcattccttggaaaattctgaagttgcattaatagtagcttcaccttatgagttttatgaagattatgaaataagcttaaaagaagaaacaattaaaaatttaaagataaaagaagcaaatgaagttatgattatgtgcacagtaactttaaattcagatgttaaaaagattactatgaatttgcaaggaccaatagttataaatacttctaataatttaggggaacaaataatagtagataattctaaatataaggtgaaaacccctttgatgaaggaggcataaaatgctgattataactagaaaaaaaggcgaatcaattatgattggtgatgatatagagataactatatcgaagatagatgatggaagtgtaaagataggaatagaagcaccgaggaatgttaatatcctaagaaaagaattatatgaagaagttgaaaaagaaaataaggaagcagtaaatattaatttgagtatactaaaaaatctaaagaaaaaataacatattataaattatgatatgtagcagtaattatttatatgaagggctttctaattaaaaattattatgcaatctatatagtaattaaaatgtgatgtgtataatcagggaggtaaaaagaacatggatgttaaaaataatattattacacatagtaacagctataatattccagaaagcaacttgtctcaatatggaactaatattagtggatcagaagttaataatggtgaaatattaccaatgaatgtgaaaagtgatatttcatcaggaggttttgaacaatcaaaagaaaaagacgagtataatcaaaaagagttagatgatgcacttgcaaagattaataattttcttaaagatgaaaagactcatgcagaatattcaagacataaggattttggaactttaatgataaaaataattgatgatgagactaaagaggtaatacttgaaattccacctcaaaagatactagatatggttgcaagtatgtgtaaacaggttggtttgttagataaaaaagtttaatttgttattaaatttagtttttaggaggaatgtatgtggagtttaagttaaataaaattgatacagatattcgtaagaagattgaagaagaaagaaaagaaaataaagtccactcaggaaaagctattaatgttaataaagactttttagaagaaaatgataacaatctgaataataaaaatgaagactcacataagaaaaaacaatttattattatagacggtataaagtataacaaaagcgagataaaagtaaatgttgagaaaagtgagaaaattagtatccaaaattctgtaggaagaattttagatactaaaaagtaggaggattttaaatgtattcaaatgggtataatgtgtataaatcgaatagtgttaactattcatctaaagaacagcttttattaatgcttgttgatggtgcggttaagtttactaaaattgggagacaagctattttagacaaagatatgcaaaaagcacacaattctttagttagagttcaagatatatttgttgaattaatgtctacattagatcaaaaagctggagattgggcagttaagatgtttagtgtatatgcatacattaaggataaactgtttgaagctaacataaaaaaagatgtagcaattatagatgaagtttttcctttgattgaaggaataagagatacgtggaatgaagcttataaaagagctaagaaataagagtttattaatgttataaaatacatagtttggaggaattaatatgacaaatagaattacgggtacaaattcaggtatagatgttgattcggttgttaaacaatctttaacaactcaacagaacaaaatagacaaagcatatcaacaacaaaaggtttacgaatatcaacagtcacaattaaaagaaatagtagaagatgttcaaaagttctatgataagtatctagacatattaagcggagatagcttattaaaaagttctgcatatgaaactgtaagttttacgactacagattcaagtggaaaagtatcgcaagctgttactgctaagggatttgcaggagctgatgtttcagaatataaggttactgtaacacaattagcacagaaagcttctgctacattagaatcaaaagacgttgtatcagggaataaagtagctataaaaatgggggataagattgcggctgttgatgttaaaatatctgatggaaaagttgatatgactgaaacggctaaagcattaaatacagaattaaaaaaacaaggaattaatgctactgcaaaatatagtgagtttgccaaggggattgtaattgaatctggagaaatgggaaaagaagtagcgtttgaattatctactaattatgatccagctagtggtgcagaaaataaatatacttcatatagtgggaaaaatgcagaaggaacaatagtcaaaggagagcaaatttattctatagataaatctagcaatgtatttactgttgataatatacaatttactttaaattcaattacaacaagtgagtcaacatctagtaatcatcttacagctttaacttcaaatgggaatattacaacaataacatctaaggataaaactactgtaatagatggtaatacaacaatagtaacatctggaaatacggttacaaaattagtcgcaaatgaagatggcacagtaacaaaaacaacaactgttaatgcagatggagtgaaagttgagatatctggagataaagaaaatccaaaagtgacggttctatcaggaagtttaagtgctaatatggaagctgattcttatccaacagaaccggataatggagttgttacgaaaaaggatcctagtggcgtaattaccgcaacaaaagatttgggcaatggaataacaattactacaacatttactccaaaagcaggaaaagatggagaatatgatgaagtcactattgcagaagttgattatgacaaatttaagcatttagatgcacagaatataacagatacgaatattgatatttctattgaatcagcagatggaaacaaaaaaacaacaaagtcagcagatggaattgaggttacaactgagatccaaaaagatggttctattttaacaacaacgagaaaaactttaagtgatggtactataagtgtagaaagtgttgaaaattcaggtgcagtcatgttgaatggggaaacagatatctctggattaaaagatactatagtaggatttgtaaatgattataataaggtaatggaaagtattaatgagaagttgtgggaaactagagacaaaaattatatgccactaacagatgagcaaaagaaagagatgtctgacacagaaatagaggcatgggaaaaaaaggcgcagactggacttcttaaaaatgatagtgatctaagaagaatacaaagtgcaatgaaaagtgcaatgtcctctatgatgagtagtactggattaacattagaatctattgggatagaaccagtagataattatacaacaaaaaatggaatgtataaaatagatgaagataaattgactaaagcacttcaaaataatgcggaagaagtaaaagatctttttacgagatcatcatcaacttataaagatgaaaagggtaaggaaataactgataaaggtggagtattaactcaactacaatcagttttgaaaagtgaatttaaatcaagtacttcatcactatcaaagagaataggatttgatggtacatcaacagaaaagaataatactctaactaataatatatcaaaacaaaagactttagcaagcaaattaaagagccaatataaagataaagaaactgcattatataaaaaatattcttcattagaagtaatgttacaaaaacttaatgctcaaactaattctttatattctatgcttggaataagttaatatgatatagtggaggaaacgatatatggacttagaacaatgtcttatagaatataaggcgttaacattagatattatggaaagaattaatatagatgaaagtgttgtatatttacttgaggagagacaagttgttttggataagataattgaacttaataaagatacctctaaatttaagtacatatgtgaatctttaaatttatttgaattagaaagggaattaaatttaattacgaaaaaagaacttgtaaatacaaaaataaaaattgaaagtttaagaaaaatgagaagtgcaaatttacagtatacttctataggatatattccatcaagatttaataaaaaaatttagaaaaactataaagtatattgtaaattactcgaaaatataattgtaagcataataagtaaaacttattaaaaggtaaagaaaaatactataagccgataataagtttgtaatgcttattaacaataaaaaatataattactgacaaggatgtcaagtaaaaatcaaggaggaaaataaaatgataattaatcacaatttaggcgcaattaatgcacaaagaaacatgggaatcaacagcggagcagctgcaaaatcaatggaaaaattaagctcgggtttaagaataaacagagcaggggacgatgcagcaggtctttcaatttctgaaaagatgagagcacaaattagaggtttagatcaagcttcaacaaatgctgaagatggtatctcaatgatacaaacagctgaaggagcattaactgaaactcactcaattcttcaaagaatgagagagttatctgtacaatcttcaaatgatactaatgtatcaactgatagagctgcaatccaagcagaaatggatgaattaacaaaagaagttgatagaatagcaaatactactgaattcaatactcaaaaattattagatggttcatttactggtaagttccaaattggagctaatgaaggacaaaatatggatttaagtattggtaaaatggatgctgcaagtttaggattaacttcaacagctatagttaaagaaactgtaacactagcagcaggatcaaacttagcggatgggacttatactgtaagtggaactaaattacttgatgcagatggtaatactgttggtatagtagatcctgctaaattgactataaatggtaatgatacaactgttagtaaaacttcaataaatgataaagcgacaatagtagtgaaagatggaaaagcagaaataagaaatcagataggtacaacaggtagtgaacttgctcctggatcatataaaatttctggaactaatgttattaaagataatgaagttgttggtactataaaagatgctaatacaattactgttaatggaaaagatgttacagatactgatttaggtttcaaaacaggtgaattaaaagcaggggctgaatttacaataaatggatcggatgtgtctactcaaaagagtgcagcaggaacaatagaaacagtaaatgcagctattgaaaaagtatcaacacaaagaagtaaattaggagctgttcaaaatagattagaacatacagttaataacttaaatacttcttcggaaaatttaacagcagcagaatcaagaattagagatactgatatggcttctgaaatgagtgaatactcaaagaacaatatattacaacaagctgcacaagctatgttagcacaagctaaatcagcaccagaacaagtattacaattattaagataatataatggttatattttgaaaagtacccttatgggtacttttttggattatacatttaacataaataatttttttctatttatattgactcatcattaaaaggtgtacttgacaagaaacattaatattataatatctaaagataactttattattgtacataatattgtaattttaaatgtcaagaacacattctggtgtatagtcttgatattgatagtaaattaataatgatttacaatatatacaccgaaagaaataaaatgatatattatgaatgataagtagagatgcaagatgaagatattaaaacctttttattatgatgattttaagtgtgtagctaataaatgtaaagatagctgttgtataggatggaatattgatattgataaaaagagctataataaatacaaaagagttaagggagagtttggcaagaaaatacaaagtggaatatgccgaaatagaagttcaacaaatgaattgaaatatggaaatatggatattaaatccaatgatggagtctgcccatttctaaatgaagaaaatttatgcgatgtatatgtaaaattaggtgaggagtatttatgcagtacatgtaaagtatatccaagactaatagagaaatatggagaaatatatgagaggaatctttctgtatcatgtccggtagtggcagaggttttagtgaagtctagtgaatatttagaatttttgttagatgaagaatcttttaataatacggataaagaatatgtgaataacaaccaatcatataatatgaaattgtatgatatattatggaaaagtagatcattatcaatagagatagcacaatatagaccaataaaattatggaagagattgatgcttattattttaacggaagaaaagattcaacatttaattaattcttcatcttatgaaaatataaatgatgttatttttatgttaaaacagactatgtctgattcgaaaataagtgatacgttagataatatttctacagttccaaaagtgaaaattttatatactaatattatacttgatatggatatggcaaagaatcatttaaataatacatttgttggatttattaatgattttaatgagtttatagtaaatgaaacaaatatggctaattcaagtaataatgttaataaagatgttcagtttttaaaacaagtagctggttgcgagaaagaatttaatgaatatttagaaaataaagaatacatattagaaaattatgttgtatacaatttgtatggtaattatatgaagtctttatatacaaaggatctacataaagaaattgtgagattagttttaagttactctatcataaataagatgttgtttggcagatggattaaaaataataaaaaattaaaagatgaagattttgttgatgcaatatattctttttcaaggaatctagaacacaatgaacagtttattaataagatttataataatataaagaatgctgggtatgattccatggcttatttggcaatgctaattagatgatgatttttcttaagaattaaaagaagagaaatttaggtaactagggttgaaaactccagtcacaagatatataaaattaaaataaagttattaacctgaacagccttcgtagacggttgaattttacgaaggtttttttgttactttacttttaaataatatctacctttttatatttataaacaatgatatgaatacattgtgacagaatttataagcgtattcaaatactttgatgatagttataatatattataatgtaagtgtaaaagaattaacgactataaaatatacaatgcttactgttaaaatgataataaagtttttaacagtatggatttatgtgaatatagtagatagaaaaaatcgaaattttatgcaatttttcttgctaatgcttcgtattgatttggagtcatataatttatagaagaatatattctttttctgttatactatcattctatatacggggacagtagatagatttgtgtaaaaacaaaatctatctactgtttttttgtatgaacagttggtagttttggaataataaaacatataagtttaggaggaattattatgacaaaaaaaattgatactaactttgactacaatgaagaaataaaaaaatgtaaaaccatcgatgatgttatgggtaagaatgggctaatacagaaacttgtaaaagatgtccttgaaaatatattagaaggcgaaatggaagagcatcttggaagaaataaatatgagcgtacagaatcaaataatcaaagcaatagaaactatagaaacgggtatagcagtaaaaatctacgaagctccttcggtgacgtcgacttagacgtaccacgtgatagaaatgcagaattcgaacctcaaattataaagaaatatgaaactgtctgtactgagttagataaaaaaattatatctttatatgctaaaggtatgagtacaagtgatatccaatcagagattgaagatctatatggaataaaaatatctccatcgatggtatctaaaataacagataaagtacttgctagcgctaccgaatggcaaaatagagctttggataaaatatatcctatcgtttatttagatgctatgtactttaaagttagaagtaatggaaagataattaataaagctgtttacatttgtttaggatatacaatggatggctataaagatattttaggtatatgggttgatgaagcagaaggtgctaagttctggttaggaatttgtaatgacttaaaaaatagaggagttaaagaaatattaattgcatgtatggatggtttaaaaggattaccacaagctattaaaacagtatttccatcagtaaatattcaaacatgtattgttcaccaaattagaaattcaatcaaatatatagcttcaaaggataaaaaggcatttatgaaggatttaaaagaagtttacaaagcatcaactgaagaacttgcgttggcgcagctagacaatttaaaatctttgtggggtgataaatacgctatagttattgattcttggtataataattggagtaatctatcaacattttttgatttctctccaagcataagaaagatgatatatactaccaatgcacttgaagggtttaatcgtcaaatacgtaaatttactaaggttagagtgatctttcctacagatgaatcgttaaataagtgtgtttacttagctacgatggaaataatagaaaaatggagtcaacctactccaaattggggtgctacgctagcggagctatcaataatatttgaagatcaattaaaagatgaattagcttagaagcttgtacttttattgattaatatgcatacttttagattttattgaaatactaaaaaaggtaataaaaaacattattagtatttcttaaatataaaaaaatattactggaaatcaaaatttccagtaataataaattgataaaaatactaattacacaaaactatctaaactctctatatacgcaaatatagctaattgtgcttgctttaagtctttatatgttgtagtgtatacttcttccttttttaaacttttatgaaatgaccctacacaggtattatcgtatggacatcctttttgctaaatgattgccttatatttagttttttacataaactttttatgccattacttgcacacagtgattcaaaatcagtgtgaaatgtaataggttgattaggagaaggttttgtgaaaagtatgctctttctaattgagtcataacaagatcatttgttatattagttcagtaagcgtagtcaattatctttttgctatataaatatagtactcatgctaaataagtcgaaccattctttcatgtatgaatataagttatatctccaacctatttttcattaatttttgtggttgtaaaatctctacttaaaacgtttttttcaatatttacaacctttttagaggatttatgtttgtatttttacagtaattgcagatagatttatttatctcataaagcgtttaactcgtttttcactaaatccagaacctctttctttcgttaaaaaatgaattttaggagagttatatctgactttgttttcaggagatatatccagtatagcttgttttaagattatttttcctttgctataaatgtcaacccatgaatggttcttccgtatttatccgtatatatgatatcattaatatatcatatatttaagaggtattaatcatgtgtaattcatcaatagatctgcaaaactttttcccaactaacaaattaaaaattactaatatattagaagatacaaaagtgattaagataagtttaaagtcacaaagtaataattgtatttgtcctaaatgcaatatcatatctaacaaatatcatggaacatatataagaaaagttcaggatttacctatattaggtaagcaagtattattagaaatcaattcatatgaatataaatgcgagaatattgattgttctaataaaactatagtagaatcttttgatggttttattagttattatagcagaatgacagagcgtttatctgattttttatgtaccttagctttggaaacaagctgtgaaggggctgcacgtatagctaaaaatatgaatatcaaagttagtggggatacaattataaaaatattactaaaaaaatatgatgaaatgaaaataaatacttgtagtagtactgttggaatagatgatttctcttttaaaaaaagacataattatggaactattattgttgatgaaaaaactcataaaccaatagccatattagatggtagggatggtaaaactttatcaacttggttaaaggataataagcatataaaagtagttacacgagatcgtgcaagtgcatatgctaaagttattgagcaagaattaccgggagctatgcaaatagctgatagattccatatacaccaaaatctattgcaagctataaaaaaagctctttacaaagaaattccttcaactataaaaattgaaaatgatattaaaactcaatgtagctctgaacagaatgaccacggtaaaaaaaatcctaaaaactgtggataactttacagctgctgagcatatacgcattaaattaatatataaaatccaagaaatgaaaaatgatggatattcaattagtgaaatatcaagacttttaggtaaagatagacgtaccattaaaagatacattcaaggagaagtacatgatttatgtaaacattccagaaaaagaaataacccatatgaaaatagagtaattagtttaataaagataggatatattgaaaaacagattgtagatatattattatcagaaggatataaactttcaaaaagcaatgcaaggcatatgattcggaaagttgttaaagaaaataacctaaagataaataagtattctcctgttagtgaaagtgttaaaactaaaaatggtgctagagatgaaaaatatatttatctaaagagaagctatatatttgattacttatggatggattctgaactatctgaaatagaaaaaaatcatatatatgctaattatccaaaggtatttagtttgaaaaagtgtattatggaatttagagaattatttaagaaaaagaatcttgcattattttatatatttgttgagaaatatataaatatagatattagtgaattatcatctttagcgaatggattattaaaagatattgaagcagttgaaaattctatttgtagtgatttaagtaatggatttgtagaaggtactaatagtaagttaaaaatgataaaaagaactatgtatggaagatgtagtaagaaacttcttgcagcaaaactaatgttagctccaaacggataaattaggaagaaccataaaaatgtaaggaaacgatcatataagaatgtacaatttagtttttataaattataattactcaagatttattgggggtaattatgattatagaaacaaatatttattcagaagttaaaattaatacattggaagatcttcataagctaaaatcaattatggaggtaaacaatttgaaagtaaataaaagccaaatagctagggaacttggtgttgatcctcgaaccgtaggcaaatatttaaatggatacgtcaaacctaccactagaaactgcaaatctaaagtagaagcttttgatcctattataaaagagcttcttggtaaagattcaattcaagtattttattataagcgcattttatggcaatatcttaaagataatcatggattagattgcgcacaatcttcgtttagaagatacatttctaatcactcagaattcaatgagtactttaataataggaaaaaaggacatatatccactacttctcctatgagatatgaaacagagagagggaaacaagcacaattggattggaaagaaaatatagaatttgtgttaaatacaggagaagttattaatataaatgtttttgtattaatactttcatactcaaggtttagagtatataaattatctcttgataaaacacaagatgtgttactttcttttttagatgagtcatttgaaacatttggaggcgtacctaaagaattacttacagataacatgaaaactgttatggatgaagctagaaccaattattataaaggaaaagtaaataataaatttcaacaatttgcagatgactatggatttaatgtccgtccctgcatagcaggaagaccgaatacaaaagctaaagttgaagcacctatgaaactattagatgaaataagagcatataatggaaccttagattatgaaggtctgcataagcttatttcagatttaaacaatagaattaatagtacatgccatacatcaactggcaaaatacctatattacatttagaaaaagaaaaagatttcttatccgaactgcctaaagagcagataagaaatcattacaaaataatcaccacaagtgttaaagtaaatcgccaaagtatgatttcatataaatcaaatcaatattctgtaccaccagaatatataggcaaaaaactaaaacttcaagtgtatgatgatcaactacatgtgtattataacacaaatttagttactattcataaaatacaaaatcagaaattaaattatcatgctgaacattatactgaaattagtgctttaacatttaataaaaaatcatatgaaatgatagaaatagctagaaataatttaaaaatgataggagaagtataccaaaatgaatagtacatatacacaacttataaataatttagaatatttgaagatgaagcaaatgattactcatttggacgaagttattgattttacaacaaagaataatttagcctttgtagatgctcttattaagctaacagctcatgaaattgattataaagaggcaaatatgattaaatctatggttaaggttggagcttttccacatcaaaaagaaattaaagattttgactttaattttcaacctggaattaataaagatcaaatattagattttttaacattacgttttctagaatcacaagaaaatattgtatttttaggttctagtggtgttggtaaaacacatcttgcgacttctataggaatcgcggctgcgaagcgacgttacagtacttatttcattaagtgcaatgatttgttgcaacagctaaagcgagcaaatctagaaaataggttggatgctagacttaagcattttagtaaatataagcttcttataatcgatgaattaggttatttacctatagataaagaagattcgaaattattttttcagttaatcgatatgaggtatgagaaaaaaagcacaattttaacaactaacataaattttaattcatgggatgatattttttatgatgctgttatcgctaacgctatcttagatagagttttacatcatgccaatgttgttacaattaatggaaagtcatatagactaaaagatcattttaaacaagacgaagactaaaaaaactacattcttaaatgatcgaaaacttacattcatggggttcttcctaatttatccgtttggagctaacattagttttgctgcaagaagtttcttactacatcttccatacatagttctttttatcatttttaacttactattagtaccttctacaaatccattacttaaatcactacaaatagaattttcaactgcttcaatatcttttaataatccattcgctaaagatgataattcactaatatctatatttatatatttctcaacaaatatataaaataatgcaagattctttttcttaaataattctctaaattccataatacactttttcaaactaaatacctttggataattagcatatatatgatttttttctatttcagatagttcagaatccatccataagtaatcaaatatatagcttctctttagataaatatatttttcatctctagcaccatttttagttttaacactttcactaacaggagaatacttatttatctttaggttattttctttaacaactttccgaatcatatgccttgcattgctttttgaaagtttatatccttctgataataatatatctacaatctgtttttcaatatatcctatctttattaaactaattactctattttcatatgggttatttctttttctggaatgtttacataaatcatgtacttctccttgaatgtatcttttaatggtacgtctatctttacctaaaagtcttgatatttcactaattgaatatccatcatttttcatttcttggattttatatattaatttaatgcgtatatgctcagcagctgtaaagttatccacagtttttaggattttttttaccgtggtcattctgttcagagctacattgagttttaatatcattttcaatttttatagttgaaggaatttctttgtaaagagctttttttatagcttgcaatagattttggtgtatatggaatctatcagctatttgcatagctcccggtaattcttgctcaataactttagcatatgcacttgcacgatctcgtgtaactacttttatatgcttattatcctttaaccaagttgataaagttttaccatccctaccatctaatatggctattggtttatgagttttttcatcaacaataatagttccataattatgtctttttttaaaagagaaatcatctattccaacagtactactacaagtatttattttcatttcatcatatttttttagtaatatttttataattgtatccccactaactttgatattcatatttttagctatacgtgcagccccttcacagcttgtttccaaagctaaggtacataaaaaatcagataaacgctctgtcattctgctataataactaataaaaccatcaaaagattctactatagttttattagaacaatcaatattctcgcatttatattcatatgaattgatttctaataatacttgcttacctaatataggtaaatcctgaacttttcttatatatgttccatgatatttgttagatatgatattgcatttaggacaaatacaattattactttgtgactttaaacttatcttaatcacttttgtatcttctaatatattagtaatttttaatttgttagttgggaaaaagttttgcagatctattgatgaattacacatgattaatacctcttaaatatatgatatattaatgatatcatatatacggataaatacggaagaaccatttttatcgtatcatttatatttgcttctggaagatttctgacgagttaattttttataatatttacttctggcaatgccgagaatggagcacattgtattaacataatgtgcatgtgaattagattttataaatttaatagatttatttaacgatttgttgcaaatatggccataacttttttcgactttataatttcacttacagtaacaacttcttcatcattaaatttgatttctttgctactattaatccaatcattaatagtagaatttgcaattccatactctttatcaattttagtaactatcattcataatttgtataattcaactatcatacatttatattcttgattatatcgtttgctcttaccaatattggacacatcctttcttagctaaatattttttacttagttggattttgtgtgtccactactttatactaacaccaatagacaaagactgctgtctaggagaactaaacaaataaaagaatgtctggaagaacttataaaagcgcaaaacatccttgaattgaaatttacaattttttaaccaaatacaagttgttttatctgagctatctttctgtttcctaaaatatgatttattataaatgaaatattatgagctaatatttttaaagtaattctaagcgttaagccccatttagactttgctaagactttatttatattaaattgttcagataattgtgaaaagctggtttctactcttcgccttgtctttgacaagacgttgcggaaccgcttttttaaaatattatcaatataacctttagcaacaattatttttattgattggttattttctgttaattcaaaaacagcttttctatcatcaattccagcaggagttaagaaaaagtcagaaacaaaaccatcaacagtaactaatgcatgaagtttcaatccccaatatatctatttttttgaagcgcaatatccatatgaagcaatatatttgaagcatttactaaagtaagctcttgcaaatttacaaactggtactggcataatgtcaataaacctaatgttatcatttgcaaacataggtaatttagaaaaatatttttgtatttctttaatagtagaatataaattatgttttgttctgttaaatcttgttctatcacaaatattaggaaatagatcttttaaattatcaattttttcagtattataataagtgaactctaacatttcaatcatctccttattatgtttttgtttggttaattatattttaatggagatgattgatttttgttagagttttttaaaaattttaactagcacaacgcgtaaagttaattaaaaagtggtttaaagagagtcttaaaagctaaaattataatgctaaaggctttaataactaaagatgttgaagtgtttggtgcattctttgaacgatttgttttgaataatgtaagttattttgatgtatatggaacagaaccggaaaaagtatatcatgcatttgtccttggaatgattgtttgtttaaataatgaatatgaacttaaatccaacaaatagagtggatatagtagatatgatgctatgcttattccacgagatagtttacgatttggaattataatggagtttaaaaagattgatgattttataaagaaaaatatagaagtaggaatacaaaaagcattaaagcagattgcagataataaatatgaagtatagctgaaagatagaggtgttagtgagagtttaaagcttgctattgtgtttaaaggaaagaaagttaggattgttgaaggatgagcaaactctcttagcgatttcagtcgcaagcttatttattaacattttagcaccttagaaattattaaaagaaaaaattataaattattttacagatagtacaaagggaaaagattttaataatatgtgcattacgacagctaaataaaatctaatagcattcgataataaagtaataaaataaatatagaaaggatttgaacatatggatttagtaagtttagcaatgaatttaagtcaggcatcactagcaacaaaggttgcaacatcagttactaaaatggcaatggatgatggggttcaagcagcaactcaaatgaccgaaatgataggggatgctgtagatcctaatttaggtaataaaatagatgtaagagcttagttaactattgagaggagaaatttattcatgagattaaataaaaatatgttctctttgaatatatacagaacatatagcaataatatttctaaagggtctaaagctcttaataatataagtagtggaatgaaaattaattctgctaaggataatccaagtaaaattggacaaaatgaaaatttaaaaataacacttttaagcagtaagaaagcagaacagaatatacaagatactaattctatgattcagacttttgatagctctatgcaagaagtaaatgatatgttaggtaggatgagacaattaacagttcagggatctaatggatcattatctagtgatgatgtaagtgctgttcaagatgaaatagattcattgagagatggaattaaggatattgttaataatactgagtttaatggaataggtatgtctgatgaaagtgttactggatttgatgctaattataagaaatctataataggggcattaggagatgagtctgttgagattccttattataatttaagtgtagaaaatttaggtatagataatcttgatatgacaaaaggaacagaaaatttagggtctatagataatgcaattactatggtgtctcgagttagagggaattatggtgcaattcaaaatagccttgaagaaacagcagaaaatctgagtgctaaaaatattaattttcaaagtgcacaaagtaagattggtgatgcagatgtggctaaggaatatttagaatattcaacatcacaaatattagttcagtcatcaattagcttaattgctcaagctaataatattccacaggatgcattgcagattttgggtaatattcctagatagatttattttgatgatgattgtggataaaaataataatattgattatgaaaaagacagataagaaattgtaataaaaaattcttatctgtcttttgttatgtaaaataattgacaaagagtccagtggttacaaagaataaaattggatataaacttgaataatagtaaattagagtaaaatgtgttgtgaaaatgttcaaactgtagaaaaatgagagaatatagtatataatatatatgttatataattgaataggcaaaattaatgaaagttaatgacgcaaagctatagggactaagggttttttgtgaatttatgtcagccagttgccgggggaaatgtatgtacctttgttattactagtttattttatacaaactagtattaaacttgctgcttttcgagtggctttttttgagagtaaataaataattttacgtgattttgcatttattatcaaaattatgagtggtgaaaatttttaaattaagacgattgcataaaatatgtaaaaaatttcggttaaaataattttgaatataaaaaaagaaaaaaatatagcgaaaaaactcatattattctataattgtaagtagattgattataagaataataactatattagagatttgaaagggaatttgggaggatttatgaaaatacagtcaggtactagcgaaaatacttatgatttgcttaaatcaggattgaaggcgtcaaatgttagggcaaaaactatatcaaataacatggcaaatataaatactaaaaattataaaagatttggtgttgtgtttgaagaaaacttaaaaaatgattcggattcaagttttaaactaaggacaactaatgaaaatcactatactgatagttcatcaaatctaaagcgaactaaagaaggtcatttgtatggtgatgaaagtaatacatatggaaataacataacaatacaacaagataatagtacaagcatgagatcagatggaaataatgttgatttggaaattgaaaaagttaatcaagctgcaaatacattaaaatacaatgcgttaataactagtatcaataacaaattcaatgggatgaaatctgttataaagtgaaacttttcaggtggagtttttactccagcttaatattagttgaacttatccaggagcgtgcagccgttatatcatatttgaagaaaaacacatataacaaactattaaattcaacatagtggtatatagtgttacggatgctagctatcggattaaatagaggaggatgttaaatgaatgcatttaaatcaatgcagataagtgctactggtctttctgctgaaagacttaggatggatacaataacttctaatatggcaaatgcaagcactacaagaagtgctgatggaagtgggccatatgtaaggaaaatagcagtatttcaggaagcactggatgcaaacaaagaaatggcaggggttaaggctgttaaaattgaaaaggataattcacctttaagaaaagagtataatccaagtcatcctgatgcggatgaaaatggatatgtaactatgcctaatgtgaatgtcttaaatgaaatggctgatatgatggtggcgacaagatcttacgaagcaaatgttgatacatttaatgctctaaaaagtatgttttcaaaggcattagaaattggaaagtagggagaatgtaaattatgagaattgaagagaattttgcaagacagcaagctttatttaatgctagatttaatagcaatcttaataatgtagatgatagtgctcaagttacaaaggatgatacttttagtaatgctttaaaaaaagcaattgatggaacaaatgaaaaacttgtagagtctgatgctgcaaccaatgcatttgttaggggagacgacataaatattgatgaagtgatgataaagaaccaagaagctagtttatgtcttcagtttttaacacaaacaagagataaattacttgaagggtatgaaacattatcaaaactgcaattgtagtaatatgtgaggagagctaaataatgaaaaaacttttagaaaaagttaaggaactttttgagaagtttaaatctcagaataagaagattaaaattgcagtgattgcctcaatagtagcagttttaatagctattgtaagcgctgtattttattcaacatcaaataaatatgcagttttattttctaatttagatacggccgatgcaaaaactgtagtagatcgtttaacaacagataaagttgaaaacaaaatagatagtagtacaaatactatatgggttcctaaaaatcaagttgacaagcttaaattggagcttgcaccagaacttaagtcaggaagtacaggctatgaacttatggatgagcaaagttcatttggtatgacagatgaagaattcaagcttaaaaagaaaagaatgcttgaaggagaaatagaaaaagtaataaaaagtttacaaccaatagataatgctaaggttaatattacagaagctgatagttctgtttttgtgaaggataaaacagaaggttcagcagctgttacaataaaacttaaagaaggagctactttaactgatgatcaagttaaagcaattgttgctgtagtttcaacaagtatagaaaatgttccaaaagaaaatgtaactgttattgatcaaaattcaaatttacttactaaagatataaatgaagaagcaaatggtcaagcaagttctgaaactatatcaaaacaacataaggctgaagaggagtatgaagatagacttcaaaagtcaattgttagtctattagaacctattgtaggtaaaggtaatgttacagcagttgtaaaggcaaatcttgattttgattctaaacaacagacagaaacaacaattgatcctaataaggttattgtaagtcaagaaactttgaaggaaactaacaaaaatggtgatgggacagtatctgaaagtcctgttgataataatatgagcaatgaaattgttgataataattcatcttcaaattcaagtaaggaagaacagaagactaattatgattctggaaaaagtgaaagtaagacaatacaagctcaaggaaaagttgatagattgactgcaacagtttatcttaataagacacttacacaggaagaaaaacaggaatttgaagatggtgttgcaaatgctataggcatagatgcaacaagaggagatcaaattactgtaagtggaatgacatttgatacaagtagtatagataaggcgcaagcagcattagatgaaatgaatgctgaagaagcagcaaataaaaagacaatgatgatgattgcaggtggagtaatcggtgcaattttattaggcggaattataatcttcatcctaaagagaagaaagaaaaaggaagaagaagaagaacaattattggatacattaattgatgatacaataattcctaaggaaccggatgcatttgatccaattgaatttgagactaaaacacaaaaatctcacttagaaaatgaaataaagaaatatgctacagaaaaaccagaacaagtagtagaaataattaaatcttggttaactgaaaatgagaggtgatagctatggcaaaggaagaacgtaaacttactggtgtacaaaaggcggcaatattatttattactcttgggcctgaagcatcatcaggtatacttaaaaagttaccagaaagtgatattcagaagataacttatgaaattgctaatattacttcagtaacagcagaacaaagagaagaaatattaaatgaatttttacaaataaataaggctagagattatattattgaaggcggaatggattatgctaagcaacttctatcaaaagcattaggaacacaaagagctaatgaaatacttgataaagtatcagaagcaacagctcagtacagacctttctcaattgcgagaaaggctgattctaagcagcttcttaatgtaataacagcagaacagcctcaaactatagcacttatattatgttacttacagcctgataaggctgctcaggttatggcagaacttccagaggaaactcaaagtgaagttgcttatagaatagcaactatgaatactacatcacctatggtaattaaagaaattgaatcagtacttgaaagtaaattatcttctgttgtaagaacagaaatgacaagtcttggtggtgttgagacattagttggaatattaaattcagttgatagaacaactgaaaagaatattacagaaggacttgaaagagaagatgcagaacttgctgataaagttaaaagctctatgtttgtctttgaagatgttatttctcttgatgatgtatcgattcaaagaattcttagagaagttgaagcaagtgatcttgctcttgctcttaaaggttgctcagatgaagttgcaaactgtatttatagaaatcaatcaaagagagctgctgcttcattgaaggaagatatggaattccttggaccagttagaattactgatgttgaaaaggcacaacaaaagattgtttctattattagaaggttagatgatgctaatgaaattataatttcgagaggtggagaagatgcaatcatcgtatagtctcataaaaaatggatttgctaagtctggagaaaaaaaagttataacaactgaatatgtgagcaaagctcagattgcagcaatagaagaagctagaaaaaatcagcttgaagaagaacttttaaatgaaagtgaaaaagtaaatagtccacaaattgatcctgaagaactactaaaaagatatgaagaaataggtcagagaataattcaggatgctgaaaatgaaaaaaaggctcttcttttaagaattcagatggaagcaagtaatgcagaaagaaatgcatatgaaaaaggctatgagcagggaatgaaaaatggatatgatgatggctataagaaagcttatgatgaaactatagaaaatgctcaaaaacaggcggcagatatagtagaaaatgctgaaaaattacttaaatctgctcaaagtgattatgcacaatatttagatagtaagaaaaatgaagttataaaacttgctttaaatattgcagaaagtataacaagaaggtctttagataaaaatgattcaatgaacgatttaattgaagaagctttcaaaatttctaaaggtgaagaaagcattattttaagatctaattcacttcatgttgatgaattaaaaaagaattgtgaaagatggaagttatcatatgcaataaaaagtgagatttttgtaataagtgatgattcaatggaacctggtaatgctatattggaaaagccaagtggtattgtaaaagttggtgtagatgttggaatggaacaggtgaagaaagctattttaggataataaaatatgaaatataaatgtagataagatagaatagaatgaaaaactgttacaattgtcaattgtcaattgtcaactgttcattggaaagggatagctatgattgatttagaggtgaattttgagcgaatattaaagaaaattaatagtacatctcctatgtatagtgagggaattgtaaaaaaggtaattggacttactatagaagtacaaggaattaaggcttttgtaggcgaactatgtattatttataacgaaagaaatttaccaattaattgtgaagttgtaggatttagagatgaatttgtaatacttatgcctcttgacgaacttataggtatatctccaggatgtagggttgtaccacaacataaacctttaagtgtaaaatgttcagataaacttcttggacatataattgatggtttagggaagccattggattgtgaaagtcttgaatatgatggtgatgactatcctttagaaaatgaagcacctgatcctatgaaaagaaaaagaataaaagaaataatgcctacgggagttcgagcaattgacggttttctaactgttggagatggacagagaataggtatatttgcaggtagtggtgttggtaaaagtacaactcttggaatgattgcaagagaagcaaaagcagatgttaatgttatttctcttataggtgaaagaggaagagaggttcttgaattcatggagaaggatttgggaccagaaggtatgaaaaagtctgttgtagtttgtgctacatcagataagccagcattaataagaatgaaaggtgcacttacagccactgcaattgcagaatattttagagatcaaggtaaaaaagtaatattaatgatggattcagtaacgagatatgcaatggctcaaagagaagttggacttgcaattggagaaccaccagcaactaaaggatacacaccttctgtatttgcaaagcttccaaagcttatggaaagagcaggaacatctatggatggttcaataacagctttttatacagtacttgttgatggtgatgattttaatgaaccaattgcagatgcagtaagagggatacttgatgggcatattgtcttatctagagatttagctcataaaaatcattatccggctattgatgttttaaatagtgtaagtagacttatgagccagattgcaccaaaggatcataaagattcagcatcattagccagagatttacttgcaacttataaggattcggaagatttaataaatataggtgcttatgttaaaggaagtaataaaaagattgatatggcagtggcttacaatgacaagttaaataattttttatgtcaaggaattgatgaaaagacttcttttgatgaaacgcagcaagaattagtatcaatgtttagataaattaaattgcatagtaggtgattaaaaatattaattacctgctgtcagttttaaattaaggcatatgtgacttgttatttttgtaatgccttatatgttaaacgaggtgatgaattatatggcagaaaagtttaagtttagtctcgataaacttcttgatataagaagagaaaaagaggaagaaagtaaaagactttttactgaaagtcagagagaaaaaagaaagattgaagaaaaaattgaagatctacaaaataattatgataaatacaaagggataagtgaacatgaggatgtagtttatcaaaaattaaaaaggtattatgtacaagggttacaaaggggtataaaaacagcaaaagatgatttgttatcaaagaatcttgaagttgataaaagaagaagagaattaatagaaaagcaaattgaaagaaagactgtagagacattaaaggaaaagaaacgctcagcatttgtcaaggaacaggaacgcattgaacaaataaatcttgatgagttagcattatatgcatttatgagaaataaaaacatttaatatttcaatgtgtaattgacattttaatttagagggtagttgaaatgtgaattgtgcattgaaatataaaaatgcacagtcttaatttgaaatttataaagagggaggtgaaaattatggttatgacgtcacaaatctcattagattttagtgaaagtagcttaaatctatcatcaaagagttccaactcattatcaagtacagtgaaaaacaaaacttccaaagaagtaagtagtgcttttgataataacaaatccgattataagacatccaacaaaaaagatgattttaaagacgtattaaactcaaagaagagttctgaggaatatagcaataaggttactgataaaaatactaaaaattctgaagaagatactagattaaaagaattaaaggataaaattcaagaacttaaagaaaaaagtgaagaggattctacaaataaagatgagattaatgaaataatcgaatcattattaaattctcttaacaatttacttggattaaaggataattcaaatgtaaatcaacaattaaatttagaaattaaagatatgtctcttgaaacttcaggaagcgattctttaaaagtattaaatcaattattagaattattaagtagtgaaaatgctaaaagtagttttgactcagaatcgttaactagtatgaaagacttactatcgcatttacaagggcaattatcagatgaatcaaaagtttcggataaaatgaaagatggcctaggtgacataatttcaaaacttacagacatgattgatgatgccaataataatggtaagaaagtattgacccttgaagagatgcttaacaaaggttattctcaagatcaaagtagtaatgataatgaaaataatgaaatgtttagtggtaagaaagaaacttctaaagaggataaatttttaaactcattattagatgataataaggataattcagttgataataaaattaacttatttgcatcaagaactcaaaatgttcaaggacaaaatactgttgtaagaggtcttacagtaaataaggctacttttactcaagatttaatacaagatgtaaagtatatgtccacaaataatcttaaggaattaactgtaaaagtaaatccggggaatcttggagagataacaataaaattaattcaagaagatggattgatgaaagcaaatttaaaagcaaactcaaaagaaactactgcattactatcacaaaaccttgcagaaattaaaaaagaacttggagatcaaagcataaaaatatctgaagttaatattgacttatataatgaagatacaactttctttaaagatggagggtttggtggaacattatctcaagaacaaggaagagatgagaataaaagttcatcaacaggtacttcaagaaattctttagaaattcaaaatgatgaagatatatttgaaaataatgctgagattgatacaacattagattttcttgcataggaggtgaggtaaatggcaacaaaagttacaaatgctttaggttatacagatagaggaacagcaattgttagctctaatacagaacttggacaaaatgcgttcatgaatatattagttgctgaacttagtaatatggatccaactcaagatcaagattcaacagcatatgttactcaaatggctgaatttgccagtatagaacaacttaataatctgaatacgacaatgagaaatttttcttatcagcaaatggttggacaagttgcaattcttaatgacagagatgcagagggaaacaataagtttggtcttattactcaagtatttaagagtggaacttatacatatgcaactgtcttagatgcagctacagggacttattctaattatgaaataagtagagttattggtacttctgattcaggatatactagtgcaaactttgaaactgcattgaattctaatttcttgtcagcaaaagcattggcagacagtggtgcaaaagcagtagttgtagaaactgaaactaaaaatgtaacatcaacagatagtgatggaaagacaagtacaacaagtacaacagttacaactgctaaaaaatgtgtaattaaaagtgcatatcttgacaaggcaggaagtcaggttaatgttacagtagcattccttgatgatgaaggaaatgaaacagatgaaacaaaggtgtataactatactagcatagttattgctggtaatttaacagatgaagttatggatgaagcagttaagaatcatacaacggttacagaaagtgataaggatgattcaactgaagaggtaagttcaaatacaaagagtactacagagggaattaaagcagcaatagcttcatatgctgcaaataatcaaaaaagtattacacaagaaaacgaaatattatccaaaatagcaggtatttaaatgagctataggataattaatggacaagcatattctgtaggaaattttgaacacattagtaataatcaaaataatttaaatgtaaaaagcacaaaagaggataagagctttagagatgtattaaaagatgttaaaaaccaaaaagaaggttttacagtatctaaacatgcagcacaaaggcttaatgagattaactttacagaagatgacatgaataaaatagaaaaaggattccaaatcgcaaaagaaaaaaactcaaaaaatactgttatgatttataaagatattgcacttattgcaagtgttgaaaataagactttgataacagcagttgagaaagaaagagctaaagagaatatattcacaaatgtggatagtgtagtaattttataggcaggaccaatacagttaacaagtaacagttagatacacaactgataactgtaaattgataactgataactgaataaagggtgcctcaatctgtggaatgacagaagcagattatacaaattatgatttggaggagtaaattatgttaagatgtatgtattccggaataagtggaatgaaggttaatcaacaaaaacttgatgtaataggtaataatatagccaatgtaggaacaacagcttttaaatcatcaagagctgagttttctgatatgttgtatcaaaattcaggagtagcaacatcacctacagctaataaaggtggtactaatgcaaaacaagtaggtcttggagcaaaacttgcaagtattgataaagtaatgtcacaaggtaatgcgttatcaactggaagaacattagatggatgtattgatggtgaaggatattttgttgttggttctggaacagtaaactatggaactggaggaactacaatagataataacatgggaattagtggcggaaatatgtcaataaattatacaagagatggaaattttcaattagattacgagggtaacttggttacatcagatggttacagagtaatgggatatttagtaacatcaaaggtttatgataaagatggtaatgaagttacagatggagctccagcatcaggtgcaagctcaatagctacaacggctgctgatccagttaaagaaggtgattgtgtatttgttaatgcagatggagttataaaagctgcagatgataaaaaattacagcctttaaaaattccggattcagtttatgttccagaatatacagatgctgatggtaaaacaatagaagcaagttggcaaaagatagcctctttcaccataggtaaggatggtgttataacagcagttcttgcaaatggaagcagaacagctcttggacaagtagctatggcatcatttaaaaatccggcagggttaacagcagtaggtggaaatttatatgaagtttctgcaaattcaggtccagtacttgttaagacttcagttaatattgataaaaatgaaaatggtacagcagcagacacaaatcttgataatagtaagggatttggagattatattcaaggatgtcttgaagcatcaaatgtagatctaacagaacaatttacagatatgataacagcaacaagaagtttccaagctgcatctaagatgattacaacaggtgatgaaatacttcagacaattacaggattgatgagataatatttaaatttacataagaaaaagcttaaaaatacataggttattaccgattattttcaattgattttatatatacattaaaacactttactgctttaaattaagataaaattgagaataaacggaggaaaaaatatgttaagatcaatgtactcaggaataagtggaatgaaagtaaatcaagctaagcttgatgttataggtaacaatattgcaaacgtaagtactacagcatttaaagcatcaagcgctagattctcagacatgctttatcaaaatagctcaacagcaacatcaccaacatcaactaaaggtggtactaatgcaaagcaggttgggcttggtgcaaaacttgcaagtattgatagagtgatgtcacaaggtaatgcattatcaacaggaagaagtttagatgcatgtgttgatggcgaaggttattttatcgttggaagtggtattattgactatgctggtgctggaagtacattaaatgataatatgagtattacaggtggaaatatgtctgtaaactatacaagagatggaaactttcaattagattatgaaggtaatttagttacatcagatggatatagagtaatgggatatctagtaactgctaaaacttatgataaagatggtaatgaaattacagatggagcccctgtgtcacaaccatcaagtattgatgaaaatggtgtagggcagtatgttgatgcagatggtgtaataaaagcagtagataataaaactcttcaaccattaagaataccagatacagtacatgtaccagaatatactgattctgatggaaatgttataccagcaagcgatcaaaaggttcagtcatttacaataggaaaggatggtattataacagcagttcttgcaaatggaagtagaacagctcttggacaagtagctatggcatcatttaaaaatccagctggattaacagcagtaggtggaaatttatatgaagcttcatctaattcaggtgcggtacttgttaaaactcctataaatattgataaaaatgaggatggatctgcagcagatacaaacttagataatagtaaaggatttggagatcttattcaagggtgtcttgaagcatcaaatgtagatttgacagagcaatttacagatatgattacagcaacaagagcattccaggcatcatcaaaaatgataaatacagcagatgaaattcttcaaacagtaacaggattaatgagatagtaattaaaaataaatatactctatagacagaaggttattctgtctatagagtattaaaaaatagatacaattgataatgtacaatgtataataacactaatagtttatttttaattaaaaagtggatgtgtacattgtccattgtctaaattgatgttataaaggggtagaattatgatagatttaactgctatgaataatacagaatttgtacttaatgcagatcatattgaaaaaatagaatgtgttccagaaacattaattacattgactaatggtaaaaagtatatcgtattagaaactgttgaagaagtaaagagtaaagttattaaatataaaaataaaatctttacatacaaaatataggaggcattaaaatgaaaaagaatgatatgttgacggccataggacttcttttaggaataggtatgatgttttatggtatggcaagtggaggattaagtgagatgcatctattctgggatgcaccatctttagcaataactatagggggatcgttagcagccgtaatgatagtaactcctatgtccgaatttaagaaatttggaacattatttgttcaggcttttaaagagccatcttcatcaagtatagaaacagttgcaaaatttagtgagttatcaagaaaagctagaaaagaagggcttttatcattagaagatgcaattaataatttagaagataaatttttaaaaaaaggtcttcaaatggttgttgatggtattgagccagagtcaattaaggaaatacttgaacttgagatagcaggtatggagacaagacatggtaatggagctagtatatttaaaacatgggggcttttgcaccaggatttggtatgcttggtactcttattgggttaatacagatgcttggaaatctttcagatgcatcaacaatagcatctggtatgggtaaggctcttattacaacttattatggttcattacttgctaatttaattgcaacaccaattgcacaaaatttatctgcaaagagtgcttatgaagtcaatatgagagaaatgatggttgagggaattattgcaattcagtcaggtgttaatcctagaattgtagaagacaagcttatatcttatttatcgccatctgaaagagaagaatatagtaaaactaatggagatagtgctcaagcaagtgaaggagtggcttagtatatggctagaaaaaagaaatcatctaataatgaattaactggtgatgaatggttaggaacgtattctgactgtgttacattgcttatgacattttttgtattattatactctatgtctacagttgatgctcaaaaagttcaggcgatttctcaggcattttcaataatgagtggaaaatctgccgacagtatattacaatatgatatgtatcaaggtagtcagcctgtacttggtggagaatcaaaagtagaaaacactatacaacaaagtgaaaatattgataaaaagaacatgtatgaaaatgtaaaagaatttgtggataagaatcagcttaatacaactatagatattgcacaggatgaaaacggagtagtattacagcttagagataacatactatttgaatcaggaaaagcagatttaattgatggaagtagtgagatacttgataaaataaatacattaatatcaactttaccgaattctattgttattgaagggcatactgataatgtgcctataagtacaagtgtatataaagataactgggacttatctactgcaagagcatcaaatgtactacgatattttacacagttaaaaggtcaggatcctacaagattttcagcggcaggatatggagagtataaacctaaggttgacaacagtactgatgagaatagagctcaaaatagaagagttaatattttaattgtttcaaataatgaggagtgatagtaatggctaaaaaagagaatgataaaggaaaagagaaggttgagggaaaagaaaaaggtggaaaaggccttatggttgttctattcattttaggattaatagttttaggaggagcaactttcggtggggcttatctatttatgaagactaataaaaccgtatcagctcaagaagttgttgttgaaaatgcatatgttgatttagaagagttcactgttaatttagctgatgaaggtggtaaaagatactttaagggagaattatctgtaggttatgataaatcaaacaaaaaaatggcagaagaaataacagccaatacagtagtaataagagatacaattatattttactttaaaggacaaaaggcagattttataaataatataaataatgagcaaaaaattaaagatgatttgattgtagctataaacaaacaattacaaaaaggtaaaataactgatattagatttaaaaatatgatagttcaataaggtaaagttatggattttgaattttttaagatgtgtatccaactttttatagctttagggataacactaggaattatatttttaagttataagatactaggaacaaaagttgaaagtataaataataataaatatgtaaaagtcatagaaagaactcaagtaacaaaagataatgcaattttagttgttaaaattggaaaaaaagggtatgtaatgacatgttctgggagtagcatggaaaaactgtcagaactatcacaggaagaaattaatgaaatagaagaaaataagaaaagatataataaggaaattatggatggatacaacaaagttgtttcagcatctaaaaataatgtttctaaggtattaaagaatataagatcaaaggaagagaaacatgagaaataagagaaaaatgttatttatgtttgcagcagcattttgcttttttatgatatttgctataaaggttcatgcagctccaacgactacagatataccacaagttaatatttcttttggagatggttcagattctccaaaagattatgtaactaatattagaatacttatattttttacagtacttgcattgcttccatcaattgtaataatggtgacgagctttacaagaatagtagttgtattttcgttcttaaaaacagctataggtgtaactcaatcggttccgaaccaaattcttacagggcttgctatctttcttactttttttataatgcagcccgtttatagtcaaatgaatactaatggtattcagccttatcttgaaaataagataacacaagaacaggcgattgatgaaatatcaaagcctttaaaagagtttatggcaaaagaaaccagacaggatgacctagaactttttattgatattaacaatgttgacaaacaaagtattgctgaagctaaagatataccttttacatccttagtaccagcatttgcaattagtgaacttagaacagcatttgaaattggatttttaatattcttaccatttttagttatagatatggtagtggcaagtgttttaatgtcaatgggtatgtttatgctaccacctacaacagtagcgcttccatttaaactaatattattcgtaatggtaaatggatggcatctattagtagaacaactgataaaaagttttatgtgaggtgtaatataatatgagtgaaataatgctaaatggagttgtgaaagatacaatagtaacagcaataaaagttggagcaccaattcttattgtggttcttgtacttggtcttataataagtattattcaagcaactacacagattcaggaacagacattaacatttgtacctaaattaatagcaactgcaattgtaggattaatgcttggaaattggatgcttcacacagttgtgtcatttacaaatagaatatttgatatgatttcaaggatatcatcataaggaggtaagcattttgattgatttagcttactttctaggaatatttttaatatttctaaggataagttcttattttgtagcaacaaaaatattttttccaagtgggactccaataatgtttaaaacaggtttttctatgatattatcatatggaataatttctggagttgaccacaatacagtactggcaattgatagcaattatatgattgcattttatattatcagtgaagtattaactggtttaatattaggatacataacaaatttagtttttcaggcagcaaagcttgctggaagctggatagatattcatgcaggattttcaatggttacagtattagatcctgcaacacaaacatcaactactcttatgggaaatttattttattttgtttccctagtattcttttttatgattaatggtcaagaattaattgtaaaatcaatatatgaaagtattagtattgtgccattaggacatacaatagtttatcaggaaactgttatgggagctgctgaaacaatagtagatttttttgtactaggtgttaaaatagccctaccaatagttttaataatagttatgactgatatttgtttaggtcttataacaaggacagtacctacaataccaataatgatttttggtatgcctataaaaaatatacttggatttataacatttttaataataatgccaacaatgcttaagattattggaactgctatatatgaacttccagatatattcaataaaatatttaaactcataccagtagtaccactggcgtttgtctttgccagtgatgataaaacagaggaagctacacctaagaaaaaatcggattctagaaaaaaaggtcagattgcaagaagtaaagatgttggtgtggctctaactatggtagtatgtacaattgctgtttcagcttgctggaatatgatgataaatggatttaaagaagtaatgatttattttttacaattacctacgttagataattttgataaactttcattaacaggaatatcaataacagtaataatgagagttgcctatggattgttaccaatagccttaccaattatggttggagggattattgctagtttaatgcagactggatttttgataacaggagaacctttaaaaccttcttttgggaaattaaatccattatcgggaataaaaaatatgatttcaaagagaagtcttgttgatttatgtaaaaatcttatagtaatatcaattgtaagtattattgcatatagatatatttcttctaattatcaacaaataatttctatgtccaatatatatttgccaagtcttaatgtagaaattaaaaatcttgttttgggtatttttaaacaaatatgtatagttcttattgtaatagcagctattgattattttgttcagtttaaaatgcataatcaagatttaaagatgtcaaagcaggaagttaaagaagaatacaaacaacaagaaggggatccacagcttaaagggaaaataaagcaaaagcagagggaaatgagtagacagagaatgatgcagtcagtatctgatgctacagtagtaattacaaatcctactcaccttgctattgcgttaaaatatgaagaaggtacagatatggaagcaccaaaggttcttgcaaaaggtgctgattatttagctttaaaaataaaatcaattgcaaaggaaaatgaaattccgataattgaaaataaaccacttgcaagaatgatgtatgataaagtagaaattgatagtgatataccaccagaattatatcaggggtagcggaaatacttgcaattgttatgaagatcaaaaagtagaaagacatagaaaactaaaagcaatgaataattgtaataagcaattggcataaacagtgtatgtattaaaaaataatttaatatatcgtgaaattgtcaattatcaattgttcaatgtcaattaaaaaagagggatgtgtgaattttgttaggagagaagaggcttgacataaaaagtaatttagatgtggtaatagcatttggagttattggaattgtacttatgataattattccattacccaaaattatgctagatttgctactagctttaaatataactatatcaatagttataattcttattaccatgtttacaactaatgtattacagctttcggtgtttcctacactattgcttgtaactacattgtttagattaggtcttaatatatcttcaacaaggcttatcttaacagaagctgatgcaggaaccatagtttcagcgtttggtgactttgttatacgtggtaattatgtggtaggtataattatattccttatcattgtagtaatacagtttatggttattacaaatggtgcaggaagagtttcagaagtatcagcaagatttacacttgatgctatgcctggtaaacagatgagtattgatgctgatttaaattcaggtatgattgatgatgccatggcaaaaaagagaagacaggatcttcaagctgaagcagatttttatggagcaatggatggtgcatctaagttcgtaaaaggtgatgctatagcaggtattatagttacaataataaatattattggtggaataattattggtgtaatgtttaatgggatggatgcaggaacagcagctcagacttatacaaagttaacagtaggggatgggcttgtaagtcaggttccagcattattgatatctacagcatctggtatattagttacacgttcaggtaatgatgaaacttttggagatactgtatcaaaccaattaacagcattccctgtggctacaggtattgcaagtgctgtaatgttgtttttaggacttgttcctaatatgcctaaaattccattctttgttgcagctgtagcaatgggtggattaacatatcttttatataaagaagatgcagcaaagcaagtggaagaggttataactgaagaagaagaaataatgcaacaggaaagaaaagagcctgaaaatgttatgaatttaatttctgttgaagcaatggaagtggaaattggatatgggctcatacctcttgcagatgaaagctcaggaggagatttgcttcaaagaattgcatcagttagaagacagtgtgcaattgaaatgggaattgtagttcaacctataagaataagagataatcttcagcttaaaactaatgaatatataattaaaataagagggacaaaagttgtatcttctgaattgatgccaagcatgcttttatgcatggacccaacaggggaaaattcagatttaccaggtataaaaacaattgaacctacatttggtcttccagcagtatggataaataaagatcaaagagaagatgctgaaattaagggattaacagtagttgatcctacgacagttatggtaacccatttaacagaaacaattaaaaaccattcttatgaattacttggaagacaagaagttaaacttattgttgacaatgctaaagagaagtatagtgctgttgttgaagaacttatacctgacttattaaccattggtgaacttcaaaaagtattgcagaatttattgagagaaaaagttccaataaaagatatagttacaataatggaatcattagcggataatgctagaaatacaagagaccttgaagtattaactgaatatgtaagattttctttatcgcgaactatatgtaatacagttgtagatgagaacagaactataaatgttgtaactttagacccagtaatagaggatatagtagcaaataatattcaaaaatcagttcagggatcattcccaactgtagatccagatacgactacgaagatacttggagcaataaaggataccgtggaaagcgtttatttttataataatcagcctataatacttgtttcacctaatataagaccagtatttagaaagcttatagaaatggtattcccacaaataatgattatttcattaaatgaagtaccaaatgatgttcaaattaatagcgaaggagttgtaagaatatagatgatcataaaaaaatatctcgttaaaaatattaatgaagctatgagtaaaatacgatatgaactcggaaaagatgctattataataagtcaaagaaaagttagaaaatcaggtttttcgggattattttccgggaaattaatagaagttacagcagcagttgaaagttctgttaatgaagaaaagaaagatgagaatcataaacaaaatattattactgaagaagatgaatttaaaaagtctattgaaagtataaaaaaactaatggagaatgaaattgcagtaacgcaaactaaggaaaagccttcagaattaaataataggataaacgaacataatagtaatgttgaaaaagaaagacaaggttcaattattgattctcttgtgggagtcgaagataatgacagtaaaataatacaaaatgatatttacaggaagaattcttcaaataataataatcatgaacttagtgttgaatctgtacataaagaagttgaagaattaaaaactttgataaataaagtaatagagaataaaagtactattttagaacctatggatgagtcaattgaagagtgtaattcattaaatttagattctttaaaagaacaattgaataatttggatattgatgaagatttctatgatgatattataaatatggctttagattataaagatgaagatattagtgaaactgagatattaagagatatttttgagagagatattcttgtaactaataaggggcttaatggaaaagttgtattagtaggacctacaggtgtaggaaagacaactacaattgcaaagcttgctggcagacttgcacttgttgaaaagaaaaaagtaggattaataactatcgatacatatagaataggggctattgaacagcttaaaacatatgcagaaataatgaatataccatttaaagttgttattactataaaagagatggaaaatgcaattgaatcaatggaagattgcgatgttgtacttatagatactactggaagaagtagtaaaaatacaatgcagatttcagaacttagagcatttgtccaaaaagctaatccagaccatgttaatatggttataagtgctacaactaagaacaaagatataaaaggtatattaaaaggctattctgaacttgaatatgaaagtgtaattgtaacaaagcttgatgaaacaacggcttatggatctatatataatatatcaagaaattctaataagcctattagttttataactattggtcaaaatgttccagatgatataaaattatcaactaaggaggaacttacacgctttatattaggggaggaaactctatgttagatcaagcagaagcgctcagaaaattagcagataatgatggaaaagagaatcaaaagaataatattagcaaaattataacagtaacatctggaaaaggtggagttggaaaaagtaattttgttgtgaatcttgctattactttacaaaaaaatggtaaaaaagttcttatttttgacgcggatcttggcatgggaaatgatgatgttcttatgggactatatcctaaacataatatatttgacattatatttactgatttgacattaaaggatataattatagaggggaatgaaggagttgctttaattccagcaggttcaggtttaaataaagttcatgaacttactgaaaatgaaaggcagttatttttaagtaaattatctgaacttgatgaatttgattatatattaatggatactggagctggagtaagtagagatatattagcatttatatctgcatcagaagaacttataataataacaactcctgaaccaacatcgcttacagatgcatacagtcttgcaaaagcagcagatcattttaaactaaaagataacgcaaaagttatagtgaataaagcgttttctaaagaagaaggaattgaaacatttaataaatttaacagagctgtgactaaatttttaaatataaaaattgaatatttaggttatattttggacgatagaaaacttgtacaaagcgtaagagctcaaaaaccatttgtaactttatatcctaattgtgatgcttctaaaaatatagaagatattgcaatgaaaattttaggacaagactctgtaaatacaggcggtgcaaaaaaactatttaaaaaactacttaatttattttcataaggggattttacacatggataattttcaactggatgtaaatgacagactcgaagttatagcaaaagataaagcatataaaagcctgataactgatgttgatgaggattggataaagattaatgttccagtttttgaaggtgaatatttagtattgtatagtggtgaaatggtaataataaatatgtatcttgataacggaaaatgctatagttttaatgctaaagtgttatcaaaaggaaaagaaggaaacataccgtattacaaattatcagaacctattaatattaaaagaatacaaagaagaaattattttagagtaggaattttaaacaatgcttactataaaaatataactaatttagataaaaatgatgttgatgatgaacaatacacagaagcaatgatgttggatttaagtggaggcggattaaaactgaaaattaatgaagatgttcagatgcatgatatattatcaattaaaatgagaataaagggttcagaaattgttgttaatggggaagttgtgcgaatagaaatttcagaagatagaaataaaatgtgtggtataaaatttttagatatttcacaatcgcaaactgatagaatcatagaagaattatttgaaataatgagaaaacaaagggctttaacataataatcaaaatataaatgagaattgaattgggaggtaattatgatgaatgcactaaaagaagttgatggaagagaacaaataatagaagaatatattccattagtaaaatatattgcctctagggttatgtttgcaaaaaataagtatatggaatatgaagatttggtaagttatgggatgattggccttattgatgcaattaataaattcgataatagcaaaggtatgaaattttcttcatatgcatctatacgaataaaaggtgctatgattgatgaacttagaaaaaatagaccaatatctaaaggtgctatggataaattaaataggtataataaagctattgaggaattgcaaggaacattgttaagagaaccgactactcaagaaatatcaaatttcctggagatatcttcaagcgaggttgctgaaattgaaaattacataaattacatatctatggtttctctagaaagtgttatattttctgatgatgaggatgtaaatctaatgggagttattgaagataaaaatagcccaagtccccattcatatttagaagataaggaaaagcttgagatattgactcaagcaattgaacttttaaaagaaaaagatagaatgatattaaatttatattattatgaaggcttaacacttaaagaaataggtaaaattcttgaagtatcagaatcaagagtatgccaactacatagtagatctatccgtaatttaagagaatgtatgaaaaaacttcactatgtagattaattaaattggaggtgtataatgcctataatactaatattaataggacttgttttagtgatatataattatattgctttaaaaaaggaatctataccgtttgaaattcatgacaatgaagaaaagttaaaaaaaaataactcctttgaaaatgtgcttgaaaagagcaaggatgaactcaatgaatataaaattgaacttggggtttttaggaaaaatgtagcggaaagtttaacagaacttcaagaagaaatattagaaataaaaaaatatttaaatattataaagaataatgagaatttatacgaagataaaatagaaaaagaaaatttaattattgaagaagatagtttttataataaatttgacaacaatgtaatatcagaaattaattttaataataattctatgaaaagaaaaagctcagatactgaaaagatagcagatagtaaaaaaactgaaaaaattaaagaacttctaaatgaaggcttgagtgaagatgaaatctgccatagattatctataagtaagggggaagtattattagtaaaagatttatacaaaaaatagaaaataaaattgccttttttatagataaaaaaattttattaggtgtaggtataggattgattttcggtgctatattcatgtggggatataaaagtactataggtttatctgatagtcaaattgaaaatagagcaagagaaatgggtatgatttataaaagtgagcagaagacaatttttaatggagaaggggagtagcaaaggatatgataagaggattttacagttcagtatcaggacttataactttacagaatgaagaagaaacaattacaaataatatagctaatgttaataataatggatataaaaaacgtttgttaacaaagcagagttttgatgacgttatgatatctaataggcaaaaactttctggtgataaatatgttagaaataatataggtactatgaatttaggtgtaaagacttcagatgttgaaacagtatttactcaaggatcatttaagtcaacagataaacagactgactttgctattgatggtagaggattttttgttgcaagaaatgcaaatggtcaacaagtttacactagagatggtaactttaaagttaatcaacaaggatatcttataacaaatgatggctgtgaggtgatggggaataacaacactacaggtgcaacagaacctatttatgttggaaatatgaatttttcacttgattctaataataatatagatttagctggtgtaggagcaactcataaattagtgacagtagattttgataatgaagactataaaaatttagagccattaggagataattatgtaactacagcaaaccctatatacaatgcaagagttaatgttgtacaaaatgcacttgaatcttcaaatgttgattctacagatgaaatgattaaacttatgcaagtaaaaagacaatttgaaacaaatcaaaaatttgtaaagatgcaagatgaaacagtacaaaaagcagcaactgaacttggaagggtttaagaatttaatttatggaaattaattatttataatttttaaataaacttcaattataaatgaaaattaggagtagtgataatttatgtttaatgtatttgcaactgggaaaagtggtatgacagcatatcaagaaaaaatggattatctttcaaatgatttagttaatagtacaacaacaggatataagggtactgatattggatttaaagatttaatgactgagtcattagatagaaaaggaaatcctattgtcaataaaaatgcagtaaatgggacaggcgttagaattggaacaaattatgctaataataagcagggaaatttattaagtacaggattgaaaactgatcttgctattgatggtaaaggctattttgcacttcaagatccagatggaacaatatcttatacaagagatggtaattttaaaatagattcaaatggttcacttgtaactgcatcaggggtaaaagtttatgttcagtatgaaccaggattttctgaaggagatccagcatttgatagtgataacatagctatagatggacaaggtggaatatctatgaatatagatggaaatgctgctctagtaggaagcatacctgtgtttactgcaattggagataaaggatttgttcctaaaggaaacaatatgtttgtaccaagtgatgatgcacaaatcaccctcagtgatgattatgatataagacaaggatttttagaagcttcaaatgtagatgcagcagaggtattttctgatgttatattgactcaaagagcattccaattgagttcgaaggcaataactactgcagacgatatttggagtatgataaatagtatgagataaataaacaataaaattatgttaatgtaattaagactgatttaatatatattgaacaaaaatatattaaatcagtcttagatttttattaaaaatacagtaaaaagtttaaaagtttatacttaatatggttttatgcctagtgaaattaatctttacaataaagattaatacaagtaaaataaatattgaactaattatgtaaaatgaaattttaaggaggaagtattgtggaaaatgtagtttatgtaactggacatagaaatcctgattcggattctatatgtgcagcatatggatatgcagctttaaaaaataagactagtgatcttccagcggtaccagtaagattaggaagtgtaaatagagagacacagtttattttagattattttaatgttgaagcaccaaaattattagaaacagttaagctaaaagtagaagatttagatatagatactatagaacctataaaaggtagcttatctttaaaaagagcttggaatattatgagagacaatcatgctaagtcactaccagtagtagatgataatggaagattgaaaggaattctttcaatttcaaacttaacatcttcatatatggaaattggagataatgatatattaggtaagagtaaaacatcaatagagaatatagtagatactcttgatgcaaaatcattatacataaataaagaatgtaaaacatttgatggaaagattgccgtaactgcaatgttaccacatagcttaagagaaatcgtagaaaaaggcgacatagcaatagttggagatagaccagacgttcaagaagcattgattgatataaatacatcattaatcattataactggctcacacgttttaggtgatgatttattgaatgaagcaaagagtaagggagttacagttataagcacaccttatgattcatttacagcttcaagattattacttcaaagtgtaccagtagaatatgtaatggctacagaaaacttaatttcattctctaaggatgaattagctgatgatattaaaggtgttatggcagaaactagatataatagttatcctgtaattgataatgaaggaatagttttaggaacagtttcaagataccacttaatttcaaatcataaaaagaaagttattcaagttgaccacaatgaaagaggtcagtcagttgatggattagaagaagcagaagttcttgaaataattgatcaccacagagtagcagatattcaaacaagcaacccaatatactttagaaatgagccaataggaagtagttcaagtatagttgctaaatgttattttgaaagaggaatagaaccttcaaaagaagcagcaggtcttttatgtggagctataatttcagatacattattatttaagagtccaacttgtacagaacaggacaaggaaatatgcttaaaattagctgagattgctggaatagaaagcgttgaagattttgctaaagaaatgtttaaagcaggtacatcattacaaggtaagactgtatcagaaatatttaatcaagactttaaaccattcagcatgggtgaaactaaagtcggagttgcacaggttaatactatggatatagatggatttatgccattaaaggatgatatgttaagctacatggcttctgaagctgaatcaaaagggtatgatgtagttatgttattattaacagatattttaacagaaggttcacaagttttagttgcaggtaatagacatgattatgtggaaaaaacttttaatgttaaattaacagattcaatggcatttttaccaggagtattatcaagaaagaaacaagtaataccaccattaactgttgttgttaattcaatgaaataatttctataagtagataatgggaatataataaaaaagagcattaaaaatttagtgctatataatagatttaaaagagtttcttaaaaagcttcattttatgtttcaaaacataaaatgaagctttttttaattataaaaataattttattttaatttacaattgttaaataatcattttaaatatattgagcgtttagatatatattagatgtttggatttatcttatgtggggatgtatatatgaaataacccagaaaacatttttataaataaatgttgttatgattatgaaataaaaaaatgtcaataatcataaataataaactacatatatgtagtttattatttataaaatgaaaggggattattcatgatagaaacagattataattttaagaaaattgaagaatataaagaaaaaattcttaaagaacaaatttatagtgaatataatgtgaaaaaatatgaaagctgtcctcactgtggatgtacacactttataaaacatggaaaatatgaaggaattcagagatatagatgtaaaaatgatcagtgcagaaaaactttttcaagcacaacatgttctgtttggaagtatttaaaacataaacctgaaaaatggcttaaatttattgaattaatgtgtgaaaatatttcgcttcaaagatgtgcagatatattgaatattacaatatcaacagctttttactggagacataaggtttttcatggaattgaaaattattataaaccaaaaagcttcaaagaacatatagttgtaagtgatttttatacacacaaatgttataagggaagtcgaagtaaacacttcacaaaagaacaaagtttaaacaataagatatctagattatttgcatatgtgcctaatgatgtaggtatattaatatgcgtggaaggtgatgaaattccacttattaatgtaaaatatgaaaaagaaaagttgatatatgattttgaaaaaagtatatcaaattatattgataaaaattgttatatacatttaaataaagttagatggagaaaaattgaggagtttacaatggaacataataaaaatctaccttatggagtgataaaaaaatatggattcaagatacgtaaaaattggagtggtatacctcacatagaggataaatttcaagtaagcagcaatacaggaaagtttataggagaattaaatagttggttatatagatttaaaggaattgcaacaaaatatcttaatcattattttaatttttactcactaattcattcatcgaggcattttgattctattaaaatttttagggatttgttaaaaaatagcttttttacttcatgttataaactaaaaagttcacatttagagaattattaaagaaaatattatatattgattaattgaagtgacatagtcaattgcattaatatttataaaatataaagtgaaatattataaatgttataataacaacatttatatataaaaaggatataccattaaaattatatatctataaggtataggtctataaggtatagggaattgtcctaataacattattatagttataaaatggatttgttaaagagattttaatgaagttataagtatgaattttaaggtgttaagtgtactacttaattattattttatataagttgaacatatctaaatatcccaatataatgtttgtttattaaaatcggaataacttttattatggaaaatatatatagtatatagagttctatatagggaggaaaagatgtgatacaagaaaaggaactgaccaaaggtcttacaacaaaggaagctgaaaaacgaatcgaaaactttggtctgaatgaattagaacataagagtaaggcatctgcaataaagatatttttatctcaattcaatgattttatggtgtgggtgttaattgcggctactattatttcaggagtaattggagatacggcagatgcggtaacaattcttattatagtcatcataaatgccatactcggttttgttcaagaattcagaacagaaaaatcacttgaagcgctcaaagaattagctgcaccaacatgcaaggtgcttagagattcaagtataaaaattattaattctatttatcttacaattggagatatagtaatacttgaagctggagatagaataccagcagatggtttttttgtagaaagctcaggtatagtagttgatgaatccttgcttacaggtgaatctgtaggtgttaataaagatgctcttaataagagtaacaatggtggatttatgggaaccacagttgttaaaggtaaagggattttcaaagtaagttctattggtatgaagactgaaatgggtaagattgcagatttgattcagaatattgatgaagaaaaatctcctttaaatcaaaaattagagtcacttggtaaagtattagtagtactttgtttagtaatatgtgcagcagttactataatgggaataattagggggaatgatattactgaaatgtttcttctaggagtaagtcttgcagtggctgccattccagaaggtcttgcagctattgttactgtagcacttgcccttggagtatcaagaatgcttaagaggaatgctttagtaagaaaacttccagcagttgaaactttaggatgtacatctgttatttgttctgataaaacaggaacattaactcaaaataagatgacagttaaagaagtctatattaatggaagaatacatgaacttgataaagaagaattacatgattatcagaaattaaaaaaggcattgatatattgtaatgactgtaattatgattttaataaaaagaaaatgagtgaagcacttcatggagatccaacagaaactgcacttataaatatgttttttaaagatcctgctaaacttaaggagtttatagaaagttcaaagagaatttttgatattccatttgactcaacaagaaagatgatgtctgttatagttaaagaggatggaaaagatacatgttatgttaagggggctccagagagagttcttgataagtgtgactacgttttagaaaataataaattaaagcctttcacatatcaaaagaaaaaacaagttgaagaatttattacagctatgtcatcaagagccttaagatgtattgcagcagcatataaggaagaaaatcttacaaagagtggtaagttagaagaacatcttatattcattggtgttgcaggtagtatagatccacctagggatgaggcaagagatgcagtattaaagtgtaagcttgcaggtataaagcctgtaatgattactggagatcatcagaatacagcacttgcaatagctaaatctttaaacatatgtaataatgaagatcaggttatgactggatctgaaatagaagaaatagatgattcagaattagaaaagaaagtaaagaaagtaagagtgtttgctagggtttcaccaagtcataaattgagaattgtaagagcatttaagagaaatggtaatatagttgcaatgactggggatggagtaaatgatgctccagctataaaagaagctgatataggtattgctatggggatatctggaacagatgtaactaaggaagcatcttcaatgattttgatggatgataatttttctactatagtggcagctgttgaagaagggcgaataatatatgataatataaggaaatttataagatatttgctatcatgtaatttgggtgaagtattaacaatgtttcttgcaactttgttttatttacctaatccattgagtcctatacaaatacttcttgttaatcttgcaactgatggacttccagcaattgctcttggtgttgatcctgctgaaaatgatattatgagacagcagccaagagaaaaaaatgaaagtatatttgcaaggggattagttgaaaaaatattagtaagaggttccctaattggattatgtacactattatcatttatggtaggtagatattatggtatggacctcgatacatgtagaacattagccttgtgtacacttgttatgtctcagcttatacatgtatttgaatgtagatctgaaagacattcaatatttgagataaaactatttacaaacccttatcttgtaggtgctgtatctatttccataattttaatatgtatggtactttatataccatttttacagaatgtatttcacactgttgcattatcattaagccaatggcttatagttgcatttttctcaggaataattgcatttataaatagtgtgtatcttttagttaaatctaaataaaatccatattaaattttatcaacaattgagtttggtgaaagtttaattttttataaaataattatggggtttttatttagatgaaaaataacatttaaaaaattcaatattaattatgtaatataaacgaaaacagctggtattcattgtgaaaaccagctgttttaacgtatacaagtttaagtataaatttatataaaactaaagtgaaattctgaaaaaatttctgggataattgctaaatctcaactatcaattgcaattatcttctcatcatatttgttgattgttgacgagattttttaatttgactatgatcaactggaattaaatctttcttagttgttaggttgaggatattcatgatttgaacttcttgagaattttcttttttgctatccttttcaccattaacacccattataataactttgtgaccttgtttaatagttataaagtcaggttttttaaaccatctatttttcttgtaccaacatttaacaactttacgacctacttcaggctttattattaattcaaccattattcttttaattataaaataatctttctcaactatttttgcagataaaatagttccagatacacttgttattctgtcgccatatttctgcatgtaagcatcttgaaagtagttaccaaacttaccacttaatttctctttaagacccatactaattactcctttgcaataataatatcaatgataatgttattatatcataggttatgtcatattggaaatttaacaataaattatatttatatattgaaaaaaagtttttacacctttttaagttagaattaatattaaaaaaataaattagacacaaatctgtcacatgaatacattaatattaaactataaagttaaataaaaaaattaagtaaacgtatattataaataagatttagctggtaataaaataaaatttcgaaaagatttatagattttagaacgaatttatatattatatgatataatgtaaatgtagaatacatcttaaagaaaacatttacaagagagttagcggtggggagatagggatgaataaaaatattaaagagatttgtgatactacagtaaaaaattatagatatgcagttcaaaatttaagatatgatggtgattatattaatcacttttctgcgcttcttaatggatattataataaaaatataccacatgatgatgttaaaaaagtaagattatacataaagaataatacgtcaaagatgtcagtatttagaggggatatgctttatatattatcctttttagtatgtgtcagcgaaaaagataatatagaaatgtgtgatagtatacttgaaacatttgatatgcttatagatgaaagatttaaagaatctgagtatttagtattgtctgcattttctatagcaagatatatagataaaagcgatagacttataacaataaaaagaactaagcatatttttaatataataaagcaaaagtatggtaatcttactaaagatgacgattatttattatgtactcttttagctgttaatggattagagtttgaatgtatgacagaatatatggattttatctttaattatatgcatgatttaaagttattctctaataacggtattcaatgtttaacaaattctatattacttaatagtaatgagaacacaccagataaaatatctaaacttctagttgctttagaagaaaatgaattaaaaatcggatatcagtttttacagctttttggagtaatggttgaaaatcaagatatagaaaaaagtatatgtgatatcaagaaaataatagaatatttatgcgatgaagaaagtgaatataatttttatatagataaagattttaggaatatgatagcctttgtaattgcttttacagagagtggtaacacagaaaaaaaatatgttgatgaactattagcctttggaacttattcattccttgtaagtaaaaatcaaggaataattaacgacgtattagcttaaactatttaaaaaataattaaatagtaaatataattaaaagatcgggcatatttatgtctgatcttattttgatgaaaaataaggctatagttataatgatgttttaatgaaaggagctttaagttatgaataataatatattacatgtggatatggatgcattttttgcatctgtagaacaaatggataatccagaacttaagggaaaacctgttattgttgggggagttagcgaaagaggggttgtttcaacttgttcttatgaagctagaaaatatggggtacattcagctatgccaatttttatggctaaagaaaaatgccctaatggtatttttattgcaggtcgttacggaagatatacaaagatatctcaggagatatttaaaattctaagtgatgttacacctataattgaacaagtatcgattgatgaggggtatcttgatttatcacaaagtagatttgaaaatggaatagatgcagcgaggtatattaaaaataaagtattcaaagaaataggattaacaatatcagttgggatatcatataataaatttttagcaaagcttgcatctgattggaataagccaaatggaataaaggaaatttcacggtccatgataccagacatattattaccactaccattatccaaaatccatggtttaggtaaaatttctgtgggaaaacttaataatatggggatattttatattaaagatctatataatatggagaaaaaattttatattgagtatttaggaaagaatggtcttgatatttatgatcgaataagaggtatagataatagaaaaatagaaactataagagagcgaaaatctgtaggtaaagaaagaacattaaaatttgatacagataataaagaagaacttttacaatacctaaaggaattttcttttgaaatagaagaaatgttatgtgcaaaaaatgttgttggaaaaactgttactcttaaatttaaaacaaaggattttgaaaatcatactagaagtagaactttgaataattatatttcttaccatgaggatatattcaatgtttctaaggaattacttgaaagtgaagaattaaagtcaaatttaaggcttataggagttagtatttcttcttttaaagaaaaagaaatcgaacaaatgacactattttaagatatttattaaaaaagtatatctattttggtactttgagaatattaatattatatactattaatttaaggaggagactactttggaaaactgcggttgatttgaagagaaaattcaaagtaggataaggtatgtaatgaagagagaactaactccaagtgaaattattttttcagcatcagttaatgatgtggcaaaacaaaccaatattaatagaataccaagaagcaatactacgttgaataaaataaaaaaagctctgagcattcaaaaggatggatacaatatatattatgttgattcattttctaaggagaaattagaagaacttgttgaatttattgaaaacatgtatatagatgataaagagccaaaagatatatgctatgttagtaataacgatagtagtaatcctattgtacttgttcttgaaaatggtaaaggacagttgcttaaagaaatgattgaagatatgaaagaaaagtatcttgagtgtataaatgaattttataacacttcttcagatgatgaaaaagaagatattattgatgatgtaactgaaaaaagaagtaactatattacaaatttaatggacatggctaaagctaaaaattttgagattaaagcaacaacagggggattcgtcttcattccaataaaagaagaaggagatgaaatgacaaaagacgaatacgatgatcttgaggatgaagatcaagaaagtatagaaaaacaagcaactaacttaaagaaagaagcagaagtaatacttgaaaagttaaaagaaattgaaattgattctatagaaaagcttaaatcattgtatagagaccatataaaaaataaaatgcagtcttataaagatgattttttacttgaatttattgcttatgataatgtgtatagatatttaatagaaatgtttgagtatttagatgatgaaatagtggaatgttatactatcaatcttgaggatgatgaagaatatattcaagaggtattagggaagttttcggttaatgttcttgtggataatactggagtaaaccatccaagggtaatatacgaagaagatcctacagtaagtaatcttattggaaatattgaatatagaaatactacaggtggatattcaacagatatgtcacttataagtgctggaagtcttgtaaaggcaaatggtggctgtttaatattgaggcttacatcgttaataaacagtggttctagttattattatttaaaaaaggcattaattcatggacaagttgactataattatacaaaaagttaccttgaagtactttcgatagctggtttaaaacctcaaccaatcccaattaatgtaaaggttattcttataggtgattatgagagctatgaagttctatttgataaggatgaggattttaaaatgatttttcctataagaatagaagcagaaagtgaacttaattatgatataaatattagaaaaaatatatgtaatataattaagaaaaagataataaaagataacttattgagtatgacagatgaagctatggatgaactcatgaaatatcttgcaaggattgcaggaagcagaagtaaaatctcaatagatgagtattatgtgaataagatactttatcttgctgataacaatgcaaaattagaaaataaaaatgaaattgataggcaagatataattaatatagcatatgaagaggaaaaaattctaagagatgtgatggagagctatactaacaaaaagatactcattactacaactggtgaaaaggtcggaataattaatgcactatctgttgttggaacaggttcatataattttggaaaacctatgagagttacttgtcttgcacttcaaggtgatggaaatataatagatattcataaggaatgcaaaatgagtggacaaattcatgaaaaatctataagtattttaaggggcttttgagcagtcttataagtccttatgaaaaattgccagtagaccttcaattgagttttgagcaaacttatggaatgatagaaggtgatagtgcatctgttgcggaaataatatgtgtgttgtcagcgttaagtaaaaagccaataaaacaaaacattgcagttacgggttcaataaatcaatttggagaaatacagcctattggaggcgtaaatgaaaaaatagaaggattccatagggtctgtaagcttatagatacagttgaaaacaagggtgtattgattccatcaagtaatactgatgaattaatattgaatgcagaagttgaagaagatataagaaatggaagatttcatatatatactatggatagtcttgatgacgcaattgaggtgttaattcttaaagagggagaaacagttacagacttttttaagagtttaaatgatgagattgttaagtataagtacgataaaggtagcaaaaagaagaagtgataattaaaactcagtgatagaatgattttatcactgagttttaattttattggatttattagagaatttaatgtaaactctataattatggaaaaaaatgtttgataaatcgaaaaaaatatgttaaaatatggtaatgaatattgtgagggaggtgtcagataataccagaggtctatttggtattaataatttatgtatttagaatttgaaaaagaaaatgagattttaattgctactctaattggagaattagatcataacagtgctgaagaagtcaggattaaaattgatgacagaattgatagagatgacataagtaaagttattttaaatttttctaaagtcacttttatggacagttctggtattggtgctgttgtagggaggtacaaaaaaattaagaataaaggcggacagctttgtattgcacagactagtagaaatgttgatagaatttttgaattggcaggtttatataaattaattgataagtataatactgtagatgaagcagttagctgtatttagatggaggggttatcaatgtcacacaataaaatggctttggagttttttagcaagtcagaaaatgaagggtttgcaagggtatcagttgctgcatttattgcacaacttgatcctacaatggatgaaataagtgatgtgaaaacagctgtttcagaggctgttacaaatgccattattcatggatatgatggacaggaagatagaactgtaagaatagaagcagaaatttatgacaatgaagttactataatagttagtgataaaggaaaggggattgaagatattaaacaagctatggagcctttgtatacttcaagaccagatttagaaagatcaggtatgggatttactgtaatggatacgtttatggattatttaagggtagagagtgaaaaaggggctggcacaagggtaattattaagaagaaattcagtacagcaagttaggtgaataaaatggataaagagaatttaaaacgagaggaatataactatgatcaaaatccagaactattatcactagctaaaaaaggtgataatgatgctatgaataagcttatagaaataaatcttccccttgtagcatccataagcaaaaaatttctaaatagaggatatgattatgaagatatatttcaaattggttctataggattagttaaggctataaataattttgatttaaattataatgtgaaattttctacttatgcagttccaatgataatgggagaaatcaaaagatttctaagagatgatggaatgattaaagtaagtcgtaatgtgaaaagtctagcaagaaaaattcactattatagagagcagttaacaaataagcttaaaagatctccaacaatagaagaattagcagaatatgctggtgtggaaaaagaggaaattgtctttgcaattgaatcggcaaacagtcttcagtatctttatgatactatacatcaagatgacggagctccagttatgttaatagacaaacttagtgaaaaaaagggtgaagatgatgttaatttaattgaaaaaatagctcttaaagaggctttgagaagtcttgatgaaaaagcaaggcagataataatgcttagatatttcaaggataaaacgcagatacaagttgcaaaaatgcttggaataagtcaggtacaagtatcaagaatagaaaaaaaagtactacttcaaatgaagaaaaaattagaagaatgatttttatgtgtaattggaaaataagtaatgataacagacttcatgctacttagatgtaaagtagtatggagtttttttgatgtatggaaaagtataatgtttgaatatagtgaattcaatagattttgacaattacaaagtaaagaaaaactatagttttcaatcaaaactgttaattgttaacattaaataaaaagagtggattagccacttttttatgatttattaataaatattttaatatgcattaagtcatattaaataaatatctttattaggactaaaaaataaatttatacaaataataaaattgataataaaaataaggaaggtgaaaaaattgagcagcaaaagtgaaatgaaagaagctagaataaagaaaaagtatgaaactatggcaaatgagattactcctaaatcaaaaatttttcaagattgcctaaaagcttttcttgttggaggtattatttgtgatgttggacagctgattcataacatatatatatattttggtttttcagaagaaaaagttatgaatattgttcctataataatgatatttataggtgcattattaactggaacaggcacatatagcaaaatagcaagttttggaggtgcagggactgttgttcctataactggattttcaaatgcagtagtttccccggcaatagaatttaaaaaggaggggtttgtttttggtgttgccgcaaagatgtttacaatagcaggaccagtgcttgtatatggcgttggaagttcggtaattgtaggtatagtttattactttatacaattatggacataggtaatagtttataagtatttgaaattacgattatagacattattaatataaatgttaaggtaatatttaatcgacatattaatagagaattattaatattagtacagaaaataacatagaaaaatgtgaatttatatgataaatgttaactaaaaaacggggtgaaacatatggaaatgaaaaagaaaaaaattggaggtcagacagtaaagttagaacatcctcctaagataatatcaacacattcaattgtaggtccaaaagaaggtgaagggccattaagttcttattttgatgtaatattaaatgatgatacatgtggaaaagatacttatgagcaggctgaaagtcaaatgatgtttacagctataagtgaagctttgaaaaaagcaaatctaaaagaaaaagatatagattatttattttccggtgatttgcttaatcaaattatatcgtcaagttttgcggcaagggaatttagcataccattttttggattgtatggagcatgttctacaatgtctgagtcattaagtcttgcatcattaataatggatggaggattcgcagatcatgttattgcaactacttcatcacatttcagttcagcagaaagacagtttagatttccgttagattatggttctcaaagaccacagacatcacaatggactgtaactggttctggtgcagctgttttgggcatgaaggtaagtttcctatggtaacttatattacgactggaaaagtaaaggactttggacaaaaggatgctaataatatgggagcagccatggctccagcagcagttgatacaatcgtagctcacttcaaggatacaggaaggaaaccagaagattatgacattatagcgactggagatcttggaaaagtgggaagagaactttcagatactttaataaaagagtatggatacgacattacatccaatcatattgattgtggagagataatttttgataacgaaaatcagaatacagatgcaggtggaagtggatgtggatgctctgctgtagtattcacaggatatttatataaaaaactaatgaaaaaagaaataaaaaaagtattattagtttctactggtgcgcttatgagtactacatcatcacttcaaggagaaacaatacctggaatagctcatgcagtagccattgaaatgaattgatttaaattattaaaggagtgaaagtacaatggattatattcgtgcatttatagttggaggacttatatgtgtaattgctcaaatactaattgataaaacaaagcttacagcaggaagaatattagtggcatttgttacaattggagtattccttggagcttttggattatatgataaattagttgaaattggaggagcaggagctacagttccactaccaagctttgggaattctctagctaaatcagtaataaaagaagtaaatgaaataggtcttttaggtgcgtttacgggtgggataaaaggtgcagcagcaggaataacagcatctattttctttggatatttaatggctcttatatttaatcctaaaactaaaaaataactataaataagaaagaaaattatacgaaaactataatatatatgttgtaaggttatagtatgaactttacaactataacttaaataacatagtgattttaatattaagtataaatttcaatatatataagttctaaatataaaatgagttaaaaatttttataggatttctttaatttatatatgaaaaaattgtatagaatatatatgcaataattttgccttttattcaaatagcatttataatgggtaagtaatatatatagtaaagggtgtatttgttgagataattatataaaataattattgaattataggaggatggggatactttggagagatattgtaataatacctgggcaaggattgttcagttgcttaatagtgataatctacagggattagatgaacagagatgtctagcattacaaaagaaatatggattaaataaggtagatgtaccaagcacaaataaactttatatgaagattgtttgtgctttaaaacagaaatatgttctagcttatataatgattataattatgctattttatcttaaaagcaatatatgtgcatatattgttactggaatacttgctgttaatttgataataacggttattcatcatataaacagagataagggaataactgaattatctaacttagagaaaaatgaggctatagttattagaggcggagtacaaaggactataaaaagtgaagaacttgttgttggagatattgttaaagttggaagtggaagtgtagttccagcagacattagaataatagaaacaaataatttactagtagatgaaaaatccataacaggagaagaaaagttaagtaataaattttctgataaaatcataggaagtgtaaatgatataaatcaaatgaaaaatattttattcaagggaacacagataaaaagcggtgacgctacaggggtagttattgcaactggaacatcatcacaacttggaaaattactttcaatgatgatatattcaagtaatagaaaacataattttggatgtgaaatctatgagcgtttaggaaaatatcttttgatttatttagcattttgtatagttttttcactttactcagttgcgttcaattctgaaatagctagaaatcactgtattacagctttatttgcacttggatgttttccaatgttttttatacaaattattggagctaaaagtgtaattaaaaagttcatagatgaaaatatacatatagtaaacttttctgtttttaatttggttaaagatgttaatatcttatttttggacaagatcggttctattagtaagaaggaaatggaagttaaaaagatatatataaataatgatataatatcaactgatgatccatatgtaaaagaaataacttttgatagaatagttgaaatatcacttatttgtaataatagtatttttaatggacaagacgataataatataggtgaacttgatgagcttgcatttttaaagtatgctgcacgaaagaaaatttataaaagttctgtagatgcaagaaatactaaaattatagatattcctatggattctgataagagttttgttacggttgttacaaaacttaaaaggggatgtagagcaaactctagaggaaatgttgattcgattttagatatatgtactcattttatggttaatggaattgaaagagaacttacagaagaaataagatctgaaataaagagaattgatatgaatctttcaatagaaggaatgataacggaaggttttgcatatagaaatttcagttatgaaccatctaaatcagaaaatatagaaagcaacatggtttttgttggaataatgggattagaaaatcctttagaagataacttggaaaatagtataagtaaaattaaggataaagcattagttccaataatatttacagaggaaagtaaattaagtgctataactaatgcagcaaaagcaaatcttataaagagtaagaatcaagtagtggcaggaatagaactggattccttaaatcaaagtgaactaaaggaattattatgtagagtaagggttttttgtagggtaacacctgatattaaatcaaagatagtatcattatttataaaagatggacacaaagttgcaacaacaggagaagttctaggggatttacctgcattaaacttatctaatgttggaattgcaaaaggaaaatcatctaatgttgttaagaaaatatgtgatgtacatattgaaaaaaattatctcgatggattctttagattgagaaattttcaaaagaccttcaataagaatattgatagagcatttagagtttattttatggttctactttcagaatttattgtgttgtttatgagtacagctgttggacaggttgatagtttagatatgtggaacattataactataaatggaatattatctataccattaactttaatgattattcttagaaaaggaagagaaataactatgaatactatgattttacgaagtattcttttaagtatagtcactttaattgcattatatggatcagaaggtaaggaagcatctgttatatctgttgttattctatctataggaacaattctatttgttatgtttaatagtggaatttcaattagaaaattttcaaatgaacttgtaatgtttcttatatcattacttatagtgtttgtatcagttttcgttataatttatattaataatgttgctataagagacattatagttattgagttgattttttcagcaatatttttcttagtatttgaaattttatgtagaaagtggcaagactcattaatgaggtgagtccatgttgttaaaaaaatttgaagaagttaataatcctataatatatatttttggagcaatagctataagctgtatttgttatggaatatatatggattttagggggctttcgatttttattggagctctcttttttgtatatattttaagttattttggaatggaattttgtatattcatattgttattttttatgacaggtttgtatattaatacttcgtactataaaatttcagataatattgaaagtatagttagaattgttgaaataaataattatgaaacaattgggaaagttaatgggaaaaatattattttagattgtaagaacaatttgatagaagggaaacgatataatataaaagctaaaatgatagatgaaagtgatagatattcaggtgtagtaggaagagcagaagtttatgaaatctatgaaaatgatgatgattttataagtggattatataaatttaagaagaatatatttgaaaggcttaaagaaaatttaggtataagaagagcaggattaataacttcaatagcatttggtgattcaaaaaatattgattatgaagacaaagatgatatgaaaaattacggaataatccatagtgtatgtgtatcaggtcttcatattgcagtagtgtatggatttttaagatatttcttgggaaataagattggactcatattatgcggtgtatatgttgtatttacaggagggaattattcaagtataagggcatttgttatgctttcaactgttgaaggaagcaagatatttaaaaggaataataattcattatcagcactttctttgtctgctttaatattacttatttttaaaccttatggaataatggaaatttcatttcacttatcatatcttgctactttgggaataatattattaaatcaaaagataaattataaactttataaattaccagaaaagataagagaaagtctaagtgtaacattaagtgcacaagtatttgttttcccatatatgatgattgtttttaaagatttttcgttgaattttatattggggaatcttatgtttataccatttgttaatattcttgtaatattaggaaatatgcttataccttcatataaattttcatggctatttgatttttttagctatctttgcttaaatataataagattttttgatgctttaataaataaaatagatttatattcaatgccaatgttttatgggaatgaatatgtagcatttttttacttatggcttttaataagtttatattttataaaaaagggttataaaaaatttatatatcttccggctatctctataattgttattgctatatctatgtatagccctataatgaatataagatattatagagaaggcgcattgctaatatgtcataagggtgatagagttcttgtatcttctaaaaaagaaattgatatggaacgtctttctaaagcttcaaacgcatcggagagttataggatagaaaaaaatatgcattttaaagataaactttctttaaaagttgtgaaaagtgattatattttaaaattaaaagataaagaatttatattaaacatgtctggtaaagaaatttattataatgattatgatataataagttttaaagatggacctgttaacaaggtctttattgttgatgataaattgatagaggtatgttcataaaataaaactcttcaagtagagctttatctttggggtgaatttgtttaggagcgtgcatgcattttctcttagctcgataaaataatatattcacttaattttatatttgagataattacttacattagtgtgaggaatattgcagatactagatatcaaataaatattaataaacatgagaggaatttaaaattgattaattacgaagtgtatgaaaaagatatagaaaaaggaaatataaaaaatggatatgtattctgtggacttgatgaagaactcataaaagatggcatagatatagtaataaataaagaagttacagatgattttaaggaacttaatttaataaaaatagatggtatgaatacaacttttgatgatatagtaaatgcatgtgaaacaatgccttttatgggagaaagaaaagttgtgttggtatatagagctactttcttacaagaaaaatgtgattctacaggaacaaaaatatataatgaactaaaaaaatatatttcagatatgccgccttatactatattggtaatgtactatctttgtaaggataaaagagataaaccaaataaaaataaaaaacttactccaattgaaaagtactttccagtggtattttgtgacaaattaaaaaaagataaatttataaaaaaggtagcagatatatttaaggaaaaggaaaaatcaataggaagaactgaacttgcttatttttgtgacaaggttcaaaacaattttgatattataaaaagagaaatagacaaacttatatcttactctgaaggaagggatataaaaaaatcagatatagatattcttatatcaagttcaagtgatgaagatatatttgatcttgttgaacttatagcttctagaaaaatagataaagcaatagatataatgaaggaaatcttatacaaatcagatcaacatatgcttataataagttctgttgaaaaacattttgcacgtctttatgaaataaaaataggtatgtctcaaggaaaaagagtacaaaattttatgtcagaatacaggcttccacagttcgtatgtgaaaaattaatgacacaaagtagtagatttacagagaaacagctttgtgagcttgttaaattatgtgtgacttctgaaacaaaaatgaaatcttcaggagcggataaaaatatggaaatggaatttatgcttataaatactcttacagtaaaaaagtaaagttgaaaaattacttattatataatagttagtattaataaatattttaatagataaaaaaataacccacctaaaaggtgggtttatcagattatgccatagcgtttaacttagcagctaatcttgatttctttctagcagccatgttcttgtgaacaactcctttagaagtagccatatctaatgacttaactactgatgtatataaagctttagcttcttcagtgttcttagcttcaacagcagcttcaaacttctttatagcagtctttaaagcagactttatcattctgttctttaaagtcttaacttcagtaactttaattcttttctttgctgattttatatttgccattcttaattcacccccttagatttttatagggtctcttgcagttttttggggaaatctgcgtacgagttcatattcaacaaaccttattataacatcagaagttatgtaattcaagtattaaattaggtgataacggaaaaaataaatttaatcaaaaaataaagtagaaagtgagattgctattaatttaaagtgaggagtgtttattgtgacaaatgtaagaacagatttagctcttgaagcaaaggaaatatatcaagaaaagcatagaaaagaaaaggatattgacggaatagaagttattaatgaaattgataatgatataaaggttacaactgtaaaagttaaagatgaaaatggggctagaaaaattggaaagccaaaaggaaactatgtaacaatagatataccagaatttacagcttatgatggggagactatggatagagtatcacaggttgtttcagaaatacttggaagaatgataaatatagatgtagaaaaaacagctcttgttgtaggtcttgggaactggaaggtgactccagatgctttaggaccaaaagtaacagaaggaataatggtaacaagacacttaaaaactgttatgccagaaattatggatgattctgtaaggccggtatgttctatagctccaggtgttcttgggataacaggagttgaaactgtggaaataattaaaggaacagttgaaagggttaagcccgatgttgttatatgtatagatgcgcttgcggcaagacgagttgaaagagttaatactacaatacaaattggtgataccggcatatcgcctggagctggtgttggaaataatagaaaacagataaatgaagataatcttggagtaaaagttattgcaataggggtgccaactgttgttgatgctgtgacaatagctaatgatactatagacatggttgtagattcattaatgaataatgcatcaagtggaaatgatttttataaaatgcttgggtcactagataaaaatgaaaaaagttcattaataagagaagtgttatcatcaaagtcccttggtgaaatgatagttactccaaaagatattgatctaataataaattctcttgctaaaataatttcaaatggcataaatatggcagttcagcctaatatggatatggaagatataaataagtttatgagttaatagaataattatgtaaaatagctaatataaatatatagtaataaaaatgagctagattaaagtgaaacttttcagttggagttttatattccagctgaaaaggacatattaggctattgccgtagaaaaaaactgttaacaactaacagtagaaacaaatatgcagtgtattcctacaactgttaactgctaactgttaactgctaactataaactggggggatttaggtgatatatgccggtaggagagaaaaaagaattagtccacagaaaaaaataagaggcagaccaaaagtaagtgtaggattagtaatattgatgattttagcaagtgttttttttataagagtgattgggattcttaaagataataaagaacgtggtgcttttgtttatgtgcaacttttaaatataggtttgcctatagtggaaaatacagtttatgatgaaggaacttatgctgaaaataaactttcaataagcaatgtgtgtttagaagctttaggacttcaaaattttacttatgaaaagatactatcaaaggaattaagcattttaggaagtatagataaattagataataataattatgtgagtaataattcatctaataacagttcaaatatgattgtttcctataatccatttactgttagtgaagatagcatatcaaaggaaacttatactagcgatagtacaaatacgcagatttacaatcctgcattaaagaaacctcttgatgaatctaaaccggaagttttaatttatcatacccatacaagtgaaaattatgatgcaaatgctcctgatagtttaaatgaagaaacaaatgtagttggtgtaggagatgttcttgaaaatgagttgaagaataactatggaatatctgtaattcatgataagactaatcactgtcaatcatatgatgatagttataatagatcagcagaaactgtagattattatttaaaagaatatggagattttaaaataataatagatcttcatagagattctgttaataacaaggcagctacaacaactgaagtatatggtatgagtgcatcaagaattatgtttgtaaatgctaaaaatagtacaagatatgaaaaaaataaagaacttacagaaaagatatttaataaaacaaaagaattgtttccaggacttccaagagaaatttacacatataatagaggtaaaaatgcttttaatcaaagtaaaagtgatggatgtgtattatttgaaataggatcgcatacaaatactccagatgaatcaaaagtaacagcacaatgtatggcaagagttattgctgaaatattaaacggaaaacaatagatatatttttattggcatatgataatgaataattaatgttaaaatatatactaaataagttttattgaataaaagacaatttaatggaaatactctaatataaggcattatcaaaaaataacaagtcaatgatttagacttgttattttctttcatatgcctaaaaagaatttataatataagttagggtgttgacattgaagagaaagtataaaaaatacgtgttaaaaactgtagtacctataattgcaatgacagtactagtcattgcatgtttgatacatattaatataataaatactaaaacattatcccctttaggaaatactaaacaaaattatgaattagtaagtgaaaaatttggagctgattttgcaaattttataaaagataattcatttttaaaaatttatgaggattctgataataaaaaagtacttgttcgtttaggagatgcagagtttaaaatttcatcagaatcagaaataattaagtatattgaaaataaaataaacagcattaaatagttatttttgtctatagttaaattttaatagcctttttaaatagatgtatgatataatttagctgatttaattataacgggggtgaaaagctaaaccttacccagttaaaagttaacaagtaataggtagcagttaaatagaaacttttgtataaaacatttatacattataattttttaatatattgtaaaaaataaagaaatcagtatcagatttcatcattaactgcaaactgtaaactgtaaactgttaattgaatataggttagtgtattatgaaaagtgaaagacaacaacatatcagaaatttttcgatagtagcacatattgatcacggtaagtcaacccttgcggacagattacttgaaactacaggaaccttaacaaagagggaaatggaagaacaagttctagataatatggagatagaaaaagaaagaggaataacaataaagtctcaagcagcaagacttatatatagaagagatgacggcgaagaatatattcttaatctaattgatactccaggtcacgtagactttaactatgaagtttcaagaagtcttgcagcttgtgagggagctgtacttgtagtagatgctactcagggtattcaagcacagactttagctaattgctatttagctttagataatgatcttgaaatagcgccagtaataaataaaatagacttaccatcagcgagacctgatgaaataaaacaagaaattgaagatattataggaattgatgctgaagaagcacctatgatatcagcaaaaacagggcttaatattaaggatgtattagagtcagtagtaaagaatataccagctcctaatgggaatgaagaagcaccgttaaaagctctaatatttgattcgtattacgatagttacaaaggtgttgtatgtattgttagagtaaaagatggaaaagtaaaaattggcgacaaaattaaacttatggcgactaataaggtatatgatgttactgaggtaggagtatttacgcctaatgtacttccaatgggaagtttaagtgcaggtgatgttggatatataactgcatctataaaaaatgtaagagatgctagagttggtgatacaataacagaagcattaaggcctacagaaaaggctttaccaggatataaaccagctattccaatggtttattcgggtatttatccagttgatggagctaaatatgatgaattaaaagaagcattggaaaagcttcaaataaatgatgcagcattgagttttgaaccagaaacatctatagcattaggttttggatttagatgtggattcttgggattattacatatggaaataattcaagaaagagtagagagagaatttaatttagatataattacaacagcaccatctgttatatacaaagtaataaaaacagatggagaaattttagaaataactaatcctacaaatcttccagaagctacagaagttgattatatggaagaacctgttgttaaagcatctataataactccaaaggattatgtaggagctgttatggaactttgccaggatcgtagaggaacatatattgatatgcaatatattgaagaaacaagagcagttgttaattacgatataccattaaatgaaattatatatgacttttttgatactttaaaatcaagaacaagaggttatgcatctttagactatgaatttaaaggatatataagaacaaagcttgttaaacttgatattctattaaatggagatgtggtagatgccttatcaatgatagttcctgatgaaagagcttatcacaaaggtagaggtattgcagaaaagttaaaagaaataattccaagacagatgtttgaagttccaattcaggcagcaattggatctaagattatagcaagagaaactgttaaagctatgagaaaagacgtattagcaaaatgttatggtggtgacatatcgagaaagaagaaacttcttgaaaagcaaaaagaaggaaagaagagaatgagacaggttggatctgttgaagtaccacaagaagcgtttatggctgtacttaaagtagattaatgaataatagttaaattaaaaaggctgaccttattggtcagtctttttgaattttaggaggaaattttaatgaaagaaatgtctttatatatacatattccattttgcaaacaaaaatgcttatattgtgattttccatcatatgcaggaaaagaaagtttaataaatgagtatattagagcattgaatgaagaaattttaagaaaatgttcaaaatataaaatagcaagtatttttgtgggtggtggtacaccatcatatttaaatgaaataaatttagaaagtctgttaaagactataaatttattagattttaaagataactttgagtttacaatagagtgtaatccaggaacacttaatgaagaaaaattagttttaatgaaaaattataatgtaaatagaataagtatgggattgcaaacaacaaatgataatcttcttaaagaaataggaagaattcatagctttgaagagtttaaaaaaaattataatcaagctagaaaggctggatttgaaaatattaatgtagatttaatgtttggattaccaaatcagcatatgaaagattggaaggcaagtttaaaagatgttatgagtcttgaacctgatcatatttcagcatatagtctcataattgaagaaggaacttgtttttataatttatacaataatgataagttaaatattccaaatgaagaagaggaaagaagtatgtatttatttacaaaaggattccttgaagattacggatataatcaatacgaaatttcaaattatgcaaaagttaacaaggaatgttttcataacaaagtatattggaaatgtaatgaatatttgggacttggagtttctgcaagttcttttgtggatgaaaaaaggttcaaaaacatagatgatattaaaatatatatagaaaagataaataataatgaagatgtaacagaagaaattcacgtaaataatataaatgatgatatggaagaatttatgtttatgggacttagaatgatagaaggaataaatctaaaaacatttaagaaaagatttggaaaagatgtatttgatatttacgatgaagtaataaaaaataatattaaaaaaggtttattagttgttgattcggaaaaactatatttgagtgagaaaggaattgaactatctaattatgtaatgagtgattttatactgaattagaatataaatcatgattatttttattttagataatcgtctgagagtagatatattctttgtgagagcaagtagggtagtaaactagagaaagttgaagaattttaaagataattaaacgcaaacgataaaatataaataataaatacatatattaaaaataaatagaattgacaaaaaacatcataaataatatatttaaaacatagtcattagcactcgttgctaatgagtgctaataaaaagaggtgagactatggggattgatgatagaaaaataaaaatacttcaagctattatcaatgactatattcgtactggtgatcctgtaggatcgagaacaattgctaaaaattatgatttgggaattggatctgcaacagtaagaaatgaaatggcagaccttgaagatctggggtatttggaacaaccacatgcttcagcaggaaggattccatcaagtaaaggatatagattgtatgttgataaattgatggaaagtcagcgacttacagcagaagagaatttaaggataaagcagtacattgtggattcagcaatgcttgaagttgataagatagtcaaacaaacaagcagcttattatcagagcttacaaagttgacatgtgtaatagaagcaccgtcagttaagaaaagttttataaaatcaattcagcttataaaagttgataatcataatatagtttctgtgtttctaacagatacaggacttataaaaaatcatattatgaaattaaatagcaatgttccgactattgatgttttaaatagaataaatgaggttgtcaattcaagactttcaggtctttcaatagaacagattaatttggaagtgataaacaaccttaaaaaggatttaggtcagtatgaagaaatattcaatgctattttgcctcttttatatgaaacattaaatgcagcagattcatcggaagtattcatggaaggaacaactaatatttttaattatccagaatacaacgatataaataaagccaaggaaatgctttctctttttaatgataaagactctataatggaattatttaatccatcagatgatatcacaataagtataggggatgaaaattataaaccacaggctaaagaatgcagcattatctcagcagaatactccttaggagatagacctgttggaaaaattggattaattggcccaagaagaatagattactcaagggttattaccattttatctcaggttgtaaaagaacttaataatatattaaataatcaaaaaatataatcatttatattcagagatgaggtgtagttaaagacttatggaagataataaagaaatgatgaatgaagaaattaagactgaagtagttgaaaatgaagaaactacagaaaaggaatcagtagttaatgatgaatctaataatgaagaaaaagtggaaacttctgaaggaagtgaaagcacagaagaggatgagcttgatatgattaaaaagcaaaataagaaacttcaagaagaattagatacaacaaaagatactcttttaagactgagagctgaatatgacaattatagaagaagatctataaaagaaaaagaaggaatatacagcgatgcttatgtagatgttgtaaaagaaatcctaccagttatagataatttagaaagagcaattgcagctgatggcacattagaagacctaaaaaaaggtgtagaaatgacaatgaagggatgccaagatgcattttctaaattaggcgttgaagaaatagatgcaactggtgaatttgatccaaacttccacaatgcagttatgcatattgaagatgaaagtttagaaaaaaatgttgttgctgaagtattccaaaagggatataaaaaggatgacaaaataataagacatacaatggttaaggttgcaaattaaatgtaattatttaataaaataaattagaaatatacttaaaatttgtttatataaattaaaaaataaaacttaaatgtttttaggaggaataaatcatggcaaagattataggtatcgatttaggaactacaaattcatgtgtagcagttatggaaggtggagaaccaacagttatagctaatacagaaggtgcaagaactactccatcagtagtatcattccaagcaaatggagaaagattagtagggcaagttgctaaaagacaagcgattactaatccagataaaacagttatttcaataaagagacatatgggaacatcttataaagttgatatagatggaaaacaatattcaccacaagaaatttcagcaatggttcttcaaaaaatcaaagctgatgcagaagcttacttaggtgaaactgtaaatcaagcagttattactgttccagcttactttaatgatagccaaagacaagcaactaaagacgcaggtaagattgcaggtcttgaagtattaagaataatcaacgaaccaacagcagcatctcttgcttacggtttagataaaatggatgaagctcataaaatattagtatatgacttaggtggaggtactttcgatgtatctatccttgacttaggtgatggtgtatttgaagtattatctacaaatggtgatactaaacttggtggagacgactttgatgaagctgttatgcactatattgcagatactttcaaagctgaaaacggaattgatttaatgcaagataaaatggcagttcaaagattaaaagaagctgctgaaaaagctaagattgaattatcatcttcaatgcaaacaaacattaacttaccatttataacagcagatgcaactggtccaaaacacattgatttaacattaactagagctaaattcgatgaattaactcacgatttagttcaaagatcaatagaaccaatgaagaaagctttagctgatgctaaattatcattaaatgatatagataagataatattagttggtggatcaacaagaattccagctgttcaagaagctgttaagaaatttacaggaaaagaaccatcaagaggagttaacccagatgaatgtgttgctgttggtgcagctatccaagctggtgtattaacaggagaagttaaggatgtagtattacttgatgttactccattaacattaggaattgaaacagcaggtggaattgctactccattaatagaaagaaatacaactattccaactaagaagagccaagtattctcaacagcagctgataaccaaacttcagttgaaatcaacgtagttcaaggtgaaagacaaatggctatggataacaagtcgcttggaagattcacattatcaggaatagctccagctccaagaggaattcctcaaatcgaagttacatttgatatagatgctaatggtattgttaaggtatctgcattagataagggaactggtaaggaagctaacatcacaattacagcttcaactaacttaagtgatgatgaagtagataaggctgtaaaagaagcagaaaaatttgctgaagaagataagaagagaaaagaaaagattgaaactgtaaatacagcagaccaaacaatctatcaaatagaaaaagctttaactgaagctggagataaagtaacagctgatgaaaaagcaaatgtagaagctaagatagaagaattaaagaagattaaagatggtgaagatatagaagctataaaagcagctatagaagctgttaaccaatcattctatccaatagctactaagatgtatcaacaagcaggagctgaaggtcaaggatttgatccaaatgctgcagctggagaacaaagtgctccacatgatgacaatgtagtagatgcagactttaaagtagacgacgataaataatagggtttactaaaatctgattttagatataattaatacagggaaggcaaactcgtcttccctttttctaaagtaaaaaagtataaacaaaagcatttgacaaaaaataactgtcaaatgtcaattaatttaatggtggtgagtataaaacaatggcaaataaagactattatgaagtgcttggccttcaaaaaggcgcaagtgatgacgaaataaaaagagcctttagaaaattagccgtaaaatatcatccagatagaaatcaagggaatgctgaagctgaagagaagtttaaggaaataaatgaagcttatcagattctttcagatccagaaaaaaaagctaaatatgatcaatttggatcagcagcatttgatggtacaggtggattcaatggcggtggattcggtggatttgacggttttgatatgggtggatttggcgatatttttgaatcattctttggcggtggcggcggtggaagctctaggagaagaaatggcccagtaagaggtaatgatatagaatacactgtgacattgacttttgaagaagctgtttttggtgttgagaaggaaatttctataactagaagtgaaaactgtgaacattgtagtggttctggtgctgagccagggacaaatgttaaaacatgtccaacatgtggtggatcaggtcaagtaagagttcaaagacaaactcctttaggaagttttgtatcaacttctacatgtgatcattgtcaaggtagtgggaagattactgagactccatgtaaggaatgtaagggaaaaggtaatataagaaagaatagaacgattaaagttaatattccagctggtgtagacacaggaaatgtaatgcctttaagaggacaaggagaacatgggctaagaggcggaactcctggtgacttatatattaaaataaatgtcactccatcgaaagtgtttacaagaaaaggaaatgacatttatatagatacacatatttctatggcaaaagctgcattaggtacagaaataactgtcgctacagtagatggaaatgttaagtatactattccagcaggtactcaatcaggaactatgtttagactaaagagcaagggaattcaaagagttaattcaacaggtaagggagatcaatacgttaaagttatagttgatattcctaaatctttaaataaagcacaagaagaagcactttatgcatttatgaaggcatctggtgaagaagctgatgagggaacaggaactcataaaaagaaactattcggaaaaaaatagagtttgatattttaaagctgtctataaatttttatagacagcttttttagaattaaaataatacagtttaaatgtacacttgcaataattaatttatatagataaatttttaatcattaaaaggatgagtaggtgttgttttgttccgaattactttgagccttaagtttatttattgtatcagtatcacctgaacgagttgcttcaataagtgtattcagatttcctgatactacaacatctcctctattaatatcatcatttttatttgattgttgatttttactttgagaatcattagaatttgaactattttcagactgaatacttgaaatttgagattgtattgttgaaatttgagattctaaaagagaaacttgtgttgatttactttcctcatctaaagttgtatcactttgaacactttttagatcactttgcaagctttttaattgactttgtaaggattgtatttgactagtgttatttgatgatgatgtataactattacttactccatttatttgcattttaacatctcctttatgtttttgttatataattcatttatctttcggtgtttaaaatcatatcttgataaattttatagaagatttatataaggtttatacaatgtttaggaatatgattagtactttagaaaatatttatattatttatattttaataatatttttaacttgtggtattttttaaaataaataataaatactaagtatgaagagagtaatgatttttaggtagaggtgatgtttttttgaatagattaaaagatgaattaataaaagaaattgaacagtttagagaattaggtcatagatttttaaatggtgacgtgtctgttatggagtttaaacatgcttctggaggtatgggggcatatgcagaaagaagtaagaatacttttatggttagacttaggattccatcaggcattacagatataaatgaattaagatgggtttgtaaaacagctgaaaaatatggcttggaaaagattcattttacaacaagagaggcgattcaatatcataatttatctatagatgatatatgtgatattatgaaagaagcactagattataatatatatacgcgaggagcaggaggaaattttcctagaaatgtagcaatgtcgcctcttgctggagttgataaatttgaagcatttgatgttacgccatatgctttagcagtaaataattattttttgcagagaataacatcgtataaacttccaagaaagattaaagtatcattttctagtagtaatatggattcaggccactgtaacattactgatttgggatttttagcggtaactgaaaataataaagaatttttaaaagtatatttaggtggaggccttgggcagaatcctagggtaggaatagcattaggtgaccttataaatcctagtgaagtgttgtattatgttgaagctatggttcagatgtttatagcagaaggagattacaataacagagctaaggcaagaattagatatattttggatagaatgggagaagaagaatttattgattgttataaaaaacatttatctattataaaagaaaaagaagatttaactttaaatttatcaccacatactattaaaaaagaaggaataaaaacacatattaaaaataacagattaatagagcagaagcaggatggcttatatagtgtgtattttcatcctattggagggcaaatttcagtatatatactcgaaaaaatattaaatttaattgatggtatgaaggatatatcaattagattaactatgactgaaggaatgtatattagaaatctaaatggagaagaagcagaaaaattgttaaatgaaactcaaaatcttggtggagagacacatttagagcaaagtatatcatgtataggagttccaacatgtcaaatcggacttttagaaagtcagaaaatgcttaatgagattatagagtattttaaagaaaagaattatacaaaagatgtattaccaagagtacatatttctggatgtggaaattcttgtgggatacatgaagcttgccttataggtcttactggaaagaagaaaaaagttgatgatgaacttcaggatacatttgaacttcatataaatggttcgtttgaagagggaagtgctagactaggaaaagtatatggtcagattttagcaaaagaaattccagaattcttatatgaactgtcacttttgattgaaaagaaaaatatgaattgtcatgactttatagataaatatgaaaacgaacttgaagatctagtcgataaatataaaaagtaaaataaaaataggttgctgagtaattatttaacacagcaacctattttagtttcatacagatggcaagatattatttagttatgttttgtgatacaatttttagtgtaaataaatatattgcaagtatagttttatttacactgaaagtacattgtaatgaaatgtttataggatttcattaagttatatgtaagaaaatatgattgattaaaattaaaaatatatatagcacataaatacaaatgagaacctatcatttatataatgtagtttattagtagttataaaagactatttaaattgataaaaaattgcaatataaattaatatatgtataattattatgaatgataaaagacggagtgaagaaaaatgagaatgagaaaaaaaccttgggcgagacctgagcttgaaagttgtgaattttttattataaatccaaaagaaaacaaaggaaaatggatagaaacttttaaaaataaagagaatcctatttatttagagcttggttgtggaaaaggcacgtttatggctgttcatggaagtgagaatcccaatgtaaattatattgcaatagatataaaagatgaagttttaggtttagctaaaagaaacattgaaaaggcttttgaagaaagaaatagagaagttgacaatgtgaaacttatggcacaggaaataggacttataaatgagatgcttggtgatggcgattcaattgatagaatatatattaatttttgcaatccatggccaaaagaaaaacataaaaagagaaggcttactcatacaagacaattaaatcaatatagaaactttttaggggataatggggagatttattttaaaaccgatgatgatgaattattcgaagaatctcttgaatattttaaagaaagtaagtttacaattaaatatataacatatgatcttcacaatagtgattttgaaggaaatattgaaacagaacatgaaagaatgttcacagaacagggaattaaaacgaagtttttaattgcagttaaaggaaattagtacataaatatagagttttattttaaatttaatataattgcagtatttaaataaaatctgcaaaatgataataattaagaatgccaattgatagtaataatgataaaaatagaagaaattcatcagagtttcaataataactgtcaattgaataagaggaaggaagaagaacatggaaggtatttggatagaagttagtgtaattacaaaaagcgaggcgttagaaccaatttcgggaatattttatggattaggatgtcctaatgttgcaattgaagatccacaagatttattatctagggatcaaggacctttaacttgggattttgcagatataaatatattagaacataagggaaatgcagcagttgttaaagcttatttctctcaagatgataaagttgatgaaattattgatacagttaaaaaaggtcttgaagaattaaagaaaatggatattgaaattggtgaaggtagtgtaagctacaaagaaatgcatgaagaagactgggcaaataactggaagcagtactacaaacctgttaagataactgacaaaattgtaataaaaccaatatgggaacaatatgaagaatcagaaaaagatttagttatagaactagatccaggaatggcatttggaacaggaactcatgaaacaacaagaatgtgtattcaagctttagataaatatgttgaacctgatacaactgtatttgatgttgggtgcggatcaggaatacttgcaattgcaggtgcaaagcttggagcaaaacatgttgtaggagttgacttagatccagttgcagttgattcagctaaggaaaatgtaggatttaataatcttgataatattgaaatattagaaggaaatcttttagatgtagttgaaggtaaagctgatatagtagttgccaatataatcgctgaaataatatgtatattaacagctgatgttaaaaaagcccttaatgaaggtggattatttataacttcaggaataattcatgatagagttgaaatggttacagacaaattaaaagaatgtggttttgaagttatggaaattaacaaggatggagaatggaactgcatagttgctaaatctatcggataggagagtttatgcataaattttttacagaacctcataatattaatgaaaatgtaggaataattgttggtgaagatgtgaaacacatttacaaagttttaagacttagtgaaggtgaagaaattattcttaataattgtgaaggtatagagtatttaggaaagataaattccataaataagagtgaagttatagtagatataattcagaagcttgatacaaataatgagagtgatataaagatttatctttttcaagggcttccaaaggggcaaaagatggatcttatagttcaaaagggaactgaattagggattaatgaatttataccaacaattactgatagagttgatgttaaacttaaaggagaatttaaaaagctagataggttaaatagaattgccttagaagcaagcaaacaatcaaaacgaagcataattcctaaagttaaagaagtaataaattttgaagaagctatgttaaacttggagaatatggatcttgttatcgttccgtatgaaaatgcagaaaactttggagttaaaactcttatgaaaaaattaagagaagaaaaagaagatttgagttatatacataatgtaggtatagtaattggtccagaaggcggatttgaggaagatgaaattaaagagttaagcaatcgtggtgcatatattgtaactcttggaagaagaattttacgtacagaaacagcaggatttactgctactgcattaattcagtatgaattaagtgatttaggaggaaactagattaatggcaagccaaattaaaataatgagagcaacaggcgatatggctaaaattaaaacaactgctgataaggtagttagaaaaaatactgatggaaaacagtatgtagccttttcaacattaggttgcagagtaaaccattatgaaacagaagctatggcagaaaagttcataagagaaggttatgaaataacagactttagcaattttgcagatgtttatgttgtaaatacatgttcagtaacaaatatgagtgataaaaaatcaagacagataataagccgagcaagaagaataaatgaaaatgctataattgctgctgttggatgctattcacaggtatcaccagaagaagtagcaaaaatagaaggtgttgatgttgttctaggaacaagaaacaaaggtgatattgtttattatgtaaataaagccaaggatgaaaaggaatcacaaattgttgttggagaagttcttagaaataaggaatttgaagatttaaatatagaagaatatcaagataaaacaagagcgtttttaaagatacaagatggatgtaatagattttgtgcttattgtttaataccatatacaagaggtgcagtttgttctaaggatcctgaaaaagtcataagtgagataaagaaacttgcggaacatgggtttaaggaaataatattatcaggaattcatacagcatcatatggtgttgatttagaaggcgatgtttctttaatgacaatattagaggaaatagaaaaagttgatggcatagaaagagtaagaataggatcaatagaaccttgtttctttacagatagtgttatcgaaaaaatgaaaagtatgaaaaaattatgcccacagtttcatttatctcttcaaagtgggtgcgatgcaactttaaagagaatgaatagaagatatactgcaaaggaatatgaagaagcagtatataaaatcagaaagaatttgaaagatgcttcaattactactgatgttatagtaggctttcccggtgagactgatgaagaatttaatttaacttatgaatatttgaagaatttaaaattaacaaaaactcatatatttaaattcagtccaagaaaaggaaccaaagcagcaactatggataatcagattgatggaacaattaaagaaaaaagaagtaaagctttgattgatcttaatgaaaaaaatgaaggaaactttagtagaagtcttgtaggaagagatatggacgtcttggtggaacaggaagtttcaaaaaaacctggagtatttgaaggttatacaagaaattacgttaaagtagaaatagttaatggtagtgaggaaataataggaaaaatagttccatgcagaatagaagaagcaaacggtgattatgtgactggaaaattattataaaaaattgttataataaaattgaattgattaatagataatattaatataactgatattatattgttattatttatatataaaagaaatttcgtaaagaatttcatctaaaagtgtcaattctcaatttttaattgtcagctggcataaggggaggtgatttagtggaagactgtattttttgtaaaataataaatggtgatataccaagcaataaaatatatgaagatgataaagtttatgcttttaatgatataaatcctgaagcaccaattcattttttagtaataccaaaagaacatattgaaagtgccaattcagtaaatgaaaataatgctgatgttatagcacatatatttaaggttattaataaattagtagtagaccttggcgttgcggaaaaaggctacagaattgtaaataactgtggagaagatggtggtcaaactgtaaaacatttacattttcatgtgcttggaggaaggaatttacaatggccaccaggctaaagtaaatattatttgaaatatgtcaggatttttgcttaatttcttgacagtaattatttaaatattgtataatacaatatgtgttattaagcccatagctgagttaatttaagctagcggagggagggatattaaatgtcagaaatcaaagttggagaaaacgaaacacttgaaagtgcgttaagaagatttaaaagaaaatgtgctagagctggtgttatctcagaagttagaaagagagaacattatgaaaagccaagcgtaaagagaaagaaaaaatcagaagctgcaagaaagagaaaattcaaataggcttatggtttcctttgaaagagggtacaattatgtcaattattaaagatagattacaagaagattggaaagctgctttaaagacaaaggacaaatttacagctaacgtaattagcactgcaaaatcggcactattattggtggaaaaaactgataatagaaagctagaagatgatgaagtcatcagcatattagctaaggaagttaagcaaagacgtgaatctctagttgagtttgaaaaaggaaacagacaagatttagtggatcagtgtaaagctgaaatagagattttgttaaaataccttcctcaacagttagatgaagaagagataagaaaaataataatagaatcagctgaacaagtgggtgcaaatagcattaaggatatgggaaaagttatgtcagctgttaaacctaaagttgtaggcagagctgatggtaaacttgtaagtcagattgtaaaagactatttaaataataaataataaaagaactcaagattttcttgagttcttttattatttttatctaaaaattcaagttttaagttattatttatttgctaaatataaaaaattacttgaaatcataaactttcaaatgttaactgataaaatttgtgcattaaatagagaatcctaacataaattacaatgagtaagtttaaataggaggacagtatggaagagaaatttcaaaaaggacgagaaaaaatattgaataaattagagtttcccagtgatatttcaatggaccttcccaagataatagtaattggaaatagagaaataacaattgaaaatcacagaggaataatagcgtttgaaagttctatggttaaaataaattcaagaataggtgcaataataataaagggaagaaactttgaaatattatttattggtgagacaagcatgactatcagcggtaaatttgaaggaatatcatatgaggagagtaagatatgatatttaataaatttatttctggaaaattaaccatagaagtaaaagcgcttagggctgaaaaaatattaaatgctatctggaataaaggtattccagttaacaatgttattaaacttgatttaacaactattatgtttgatgcagagtatgcaaattatgatgaaatactatctatagtaaaaaagtataaaggtaaaattaggataactaataagaatggatggctttttaggctgatagaactaaaaaaaagtatatctttagttgtaggagtgtttattttttttggaataatatatggattatctaactatatatggtctattgatatagaaacaaaagaaaatcttactccatttgaagtaagaaggcagcttgattctattggaataaaaccaggtttgaaaaaaacagatataaatgtatatgaaatagagagaaaaatgcagactataaataatcagataatgtggataagaacaaggattgagggttcaacgttacatttagtaatagaagaaaaggttaatcctccatcaactgaagcgaaagagtctgattcggttgtggcaaaaactgatggagagataaaaagagtatacacatactctggaaatccagctgtagtaccaggagacatagtaaaagaaggtgatgtattaatccatccagttcaaggaagagagggatttgaagtagatacaaaaccaaaaggaaaagtaattgcaaatacattctatgataaatatatggaagttcaggttgatggtgaaaaacttgagagaagtggagataaacaaagcgatatatatctaagcttttggggcagaaaaatttacttgaaaaaagttataaataaatttcagtattatgataaaatagaagaaaacaatggagtttttaacagtatagtatattttgagaaaaaggcaactcctgtagagggagataaagataaaattattgaggacgcatgtaataaactagaggattctctgaaaagaacccttagcaatgatgttaaaataataaataaggacattacaacagaagatattggtgaaggaaaattgttagtaaaagttatatttacagtagaacaggatatagctaagaatatatcgtgattttttattgaagatgaaaaggtgattaacatgaaggttaaacaagatattaatattaaaaaaaggaataatataagaagaatattgttatttgtaggtgtttttgtattatcatatttattacttataacagcaataaagcctcaacagtatagtttagaggtaggagatataccgagatcagatataaaggctccaagagatacaatagatgaaagagcaacaaaggaagctgaagataaggctttagagaaggttgataaacagtatactcaaaaagcagaagtcaaaaagcaagcagaagataatgttatacttctttttgaaaaattaaatactataataaataatcaaagtgctcagacagccacatctacaagtgttgagagtaatgttagcgagctgaaaaaaatagaaggtattgctttaagtgaggatgaatataaagagcttttaaatattccaaaagagcaattaagctctttacagaaggatattttaaatataatagataaaacttatgagaaaaatatcaatgaaaaggatgatgagagtttaaatatagctagagacagtgcagtttctttagtagaaaaattaaatttggcagataagcttaaatatgtgcttgaggaattggttaaaggtcagataaatccaaactgtttttatgatgaagaaaaaacacaagaattaatagatgaaactcgtaaatcagtagcaaaagtagtaattaaacaaaatcagattatagttaaagaaggtgtacctgtaactcagaatgaattagatattctatctgatttgggaatgcttgatgatggtaagaatacttctatatatttatatgtatacattgtgcttgcgatgtttgtaggtataattatgtttcttcaatacaattatattgatagaaattattcggaaatatttaaaaatactaagaaaataacactaataagtgttattaatcttatgacacttgtatttgctagaacaataggtttggtatcaccgtacttaataccttttgcatgtgcaccaatattattgacattacttattaattataaaatatcaatagtaataagtatattaaatgtgatagtaataagtatagctacagggtttgatgcgcaggttatgatgcttggggttattagttcaatattaggtgccactcttttgaaaaaaatgcaacagagaaatgaacttttatattcaactttatatctatcaatagtaggtgtaataattacagtgtctacaggaatattaatatcgagcaatttaagagaagtgttgattaaaagtgcaataacatttataggcggtgttttatcaggaatatttgcactaggaatacttccgtttttggaaggaacatttaatgaagttacaacactaaagcttttagaattatcaaatccaaatcatccacttttgaaaaagttattaatggaagcaccaggaacatatcaccatagtatgcttgttgctaatcttgcagaaatggcatcagaggaagtgggagcaaattcggtaatagtaagaattggatcatactatcatgatgttggaaaaacagaaagaccgtatttctttggggaaaatcagatgggaggagaaaatcctcataatcatatgactcctaatttgagtgcaaaaattataatttctcatgttaaagatggtattgaacttgcaagaaagtataatcttcctaaagttattcaggatataataggagagcatcatggaacaacacttgttaaatacttttattatacaatgaaaaataatagtgaaaatccagaagaagttaaagaagaagattatagatatccaggtccaattcctaattctaaggaagcaggaataattatgcttgctgatagtgttgaagcagcagttagatccataaaggaacctagtgaagataagattaaggaaatgataaataatattattagtgataaattatcatgtggtcagcttaatgactgcaatcttacaataaaggatatagaaaagattaagaagtgctttttaacagcattaaatggaatatatcaccatagaattgagtatcctaaagaaaaaattaagagtttaaatgaagagaataatgacaataataaaaatgaggagaaaactaaatgatttatgtagataacagacagaaaaaaatagaagtagataatagattagaagaggaacttaaaaaagttatagaatttgctcttaaagaagaagaggtagaaattccatgtgaagtttctttgttatttgtagataatgaagaaatacgtgaaattaataatgagacaagaaatattgatagggaaactgatgtgttatcttttcctatgcttgattacgacaataaaaaaatctttaaggaaatgtataagggttatgaattttcgcagagtgattttgatggagaagaacttgttcttggtgatatagttctatctttagaaaaagcactagaacaaagcttagaattcaatcattcttttgaaagagaagcttcatatctcgtggtacattcagtacttcatcttttaggatatgatcatatggaagaagaagataaagttataatgagaaaaagagaagaagaaattctaaatgaacttaacataacaagagaaatataaaatacgagctgatagttaatactaaaatataataaattaactatcagctttaaattcttaaatgagtggagttgagttggggctatgaaaatgaaaaaagttctagatagttttaataatgcaataaatgggataatagatacagtgcgtacagaacgtaatatgaaaatacatcttatagtatctttatttatcttaatagggtgttttttctttgatgtcacaaagtatgaatttttgattcttgcagttactatatcaatggttataagtgctgaaatagtgaatacagctatagaggctgctatagatatgacgactaattattatcatcctttggcaaaagttgcaaaaaatgcagcagcaggtgctgtgctggtaacagccataaatgcagttgtagttgggtatataatattttgggataagttatcaaatctttcatatacacttgtaaaaagagtaaaaacatcagaaccatatactatatttattgttcttgttattgtatgtatagcaacaataatagttaaagcgatttttggggaagggacccctttaaaaggaggtatgccaagcggacatagtgcattggcgttttcaattgctacagctatatctttgataactgaagaaccaatatgtatacttttaagttttttacttgcagtaataactgcacaaagtagagtggattcagaagttcatactgttttagaagttgttgttggtgctgtttttgggatgcttctcactgtttttatatttactgtatttaggatttaataattaatgtgattaataaatatgaaattgtatacactaaaaatatttttaaatgttaaatataactttacttattaaaaagccagttataaacaattgtctattgaaaataaatagagtatactattaactatagcaggtgaaaattaaagagaaaataaatttaatttagtttgtgaaaatattctaaaattttatcatatatcattaacatataatttgagtcatgtatagattatagtataaaatattgcttaatatatgtgtattcgaatataattttaagatgtaaaattagtaatttataaacttataagacaaaactttaaaaagaagcctagaaatctaggctataaggaggaagaatgtttaaatcaggatttgtaacaattgttggaagacctaatgttggaaaatcaactttattaaattatataatgggagaaaaattatctatagtttctaataagcctcaaactactagaaataatatacagacaatattaactggtgatgattttcaaatggtgtttgttgatactccaggaatacataaacctaaacataaattaggagagttcatggttaattctgcaaaggaatcaacaaaagatgttgatttagttttgtttttaactaacccatgtgaagaaataggtaaaggtgatagatttatattagaaacattaaaaggtaaaaaatgtccagtattttttgtactaaataaagttgatgagaatactcaagacagagtagcaaaaacattagaaatgttttctaaagaatttgaatttgctgaaatagtaccaatttctgctataaaaggtaagaatgtagatgctttattagacttaatgaaaaaagctatgccagaaggtcctaaatattatccagatgatatgataacagatgttcaagaaaaatttgttatatctgaaatagtaagagaaaaggcattaagaactctaagggatgaagtgccacatggtattgcagtagatatacttcagatgaaacaaaacgaaagaggaacgtaccacattgaagtggatctgatatgtgaaaaagattctcataaaggaataataattggaaagaatggtcagacacttaaaagaattggcgaaacatcaagatatgaaatagaaaaattcctaagagcaaaagttaatataaaaatatgggttaaggttagaaaagaatggcgtgataatcaaaacttattgaaagaattagggtataagaagagtaaataggagatgattaatctgtcagtttttgagactaaagcagtaataataaaaactcaagattatagagaaaacgataagctggtttggttctatactgaaaaacttggaaagataacagctatagtaagaggggctaaaaagagcaagagtaagtttttatctcttactctgcccttgtgctatggtgaatatatggtgtataagggtaaaaatttatatactcttcaagaagggaaaataataaactcatttcaaggacttttaaataatttagacaaacttacttattcttcttatttgtgtgagttaattgatattgcttgtgaagaaaatgaagtgaatgagaaactttttaaagatcttgttacaatattgtatttgctaaatacagatgtacttgactatgaaattttaattagggcctttgaaataaaattattaaaagcaacaggatatagtttaacattagatacgtgtagcatatgtaggaaaagactaggtgtttctaattatataagcttatcttcctttgggggagtatgtgaagagtgtcctaaggaacatggggtatatgtatctaagggtgcatataatgctttaaggtatttaatgacagttaatgtagataagctatatagattgaatttaaacaatgagataaaacatgaaatagaaaaggtaacgaccttttttatagctaataattatacaaagaaacctaaaagcttagaaatgttgaaatttattaaggagtgattatttatggaaaatataacattagaacaagttgatgtagtacgtgaaagatgcaatgtgtcttatgcacaagcaaaagaagctcttgaggcttgtaatggagatgtacttgaagcgataatctatatagaacaaaatcaaaagaaagaaaatgaaaatagtgaaactaaagaaaatgagtatgcttttaatgcaatatctatggaagagttaaaaaatctgataaaaggtttgattgaaaaaggtaatgttacaagaataaaaattaaaaaggatgataaagaaatattagatatacctgttaatgctggaatagcagctagtgtaatagcaattacaattccaccaatattagcagctgttgttattgcagctatagcaactcaaattactattgaagtgacaaaggaagatggatcggtagaagttattaataagtatgttactcaggtagctaatgatgttaaaaataaggcatcagatttagctgatgtagttaagaataaagttaatgatgttaagacagaagttaaaaattcaaaagatgaagatggaaaaacatttactggtggagaaacaatatatacttatacagtagattttgaagaagaaaagaaaaataattctgacgaaaattagcttaatattacaataaaaaatagaaaaaataatttaaaatcactatacaagagatatttgataaatttgtttgatttttctgaaaattcactctagtaaaacacgaaaatagtgttataataaaagtgtgataaaaatgaatattattcaaatatttcttgtatttatagaaagagggataaatttgaaattatcacctagacaggaagagataataaatttagtaaaagaaaatcaaccgataacaagcgaagcgctagctgagagattaggtgttacaagggcagctttaagagctgatttagcagtgcttactatgataggtacattagatgctagacctaaggttggttatgtatatcaaggtaaatcatcaagcggcttagtttatcaacatataagtaaaataaaggtatctgaaataatgtcaaaacctaccactgttaatgaagacacaatggtgtatgatgcaatcgtatacttgtttttaaacgatgtaggaacattgtttattgagaataatggaatattaactggtgcggtttctagaaaggattttcttaaaatttcaataggtggaactgatatacacaaggttccagttggagttataatgacaagaatgcctaacataatatgtgcctgtaaagatgataatgcatatgatttggctaaaaaaattatagaacacgagattgatagtataccgatagttgaaaatgttgagaatagtcaagaaaaggaacaatttaggattattgggaaggtttctaagacaaatattacaaaattatttgttaaacttggaagtaatggagaataaatttgggaaaaaagggaattatttattagggtaactacgaatttttataagaagttcgttagtatatatattattgagaaatttataggaaaagagggagtattgatatgacaaagaaatacgtttatctttttagtgagggaaatgcttcaatgaggaatctgcttggaggaaagggcgcaaacttagcagaaatgacaaagataggaattccagttccaagtgggtttacagttacgacagaggcatgtactaagtatcatgaagatggtcaagagatttcatctgaaattctagatgaagtatatgcaagtttaacaaagcttgaagaaattacaggtaaaaaattcggagataatacaaatcctctattagtttcagtaagatctggtgcaagagtatcaatgcctggtatgatggacactatattaaatttaggattgaacgatatagctgttgaagctatggctagtttaactaataatcctagatttgcatatgactcatatagaagatttatccaaatgttctctgatgttgttatggatattgaaaagagattatttgaaaataagattgatgaaataaaagaaaaaaatggcgtagaattcgatactcaactaacagcagatgatttaaaagaattagttgctcaatttaaggaaatatataagaaagaaaaaggcgaagattttccacaagatccaaaggtacagctagtagaatcaatcaaagctgtatttagatcatgggaaaacccaagagctatcgtatatagaaggttaaatgatataccaggtgaatggggaacagcagtaaatgttcaacaaatggtatttggtaataaaggagaaacttcaggaacaggagttgttttttcaagaaatcctgcaactggagataaaggaatttttggtgaatatttaatgaatgctcaaggtgaagacgttgttgctggtattagaactccacaaccaataggaaagctagaagagcaaaatcctgaaatttacaaacaattcattggaattgttaatacattagaaaatcactataaagatatgcaagatatggaaataactatagaagaaggtaagttatatttcttacaaactagaaatggaaagagaacagctcaagcagcattaaaaattgctgttgatttagtagaagaaggaatgttgactaaaacagaagctgtattaaaggttgaaccaaaacaattggatacattattacatccagcattttatactgaagatttaaagaatgctgaaccaattgcaaaaggtttgccggcatctccaggagcagcatgtggtaaaatagcatttacagcagatgaagctaaagaaagagctagtctcggtgaaaatgtagtattagtaagattagaaacttcacctgaagatatagaaggtatgatagctgctaaaggtattttaacagtaagagggggaatgacttcccatgcagctgttgttgctagaggtatgggtacttgttgtgtagcaggatgtggatcaattaaagttgatgagaaaaagaagactgttgaagttaatggaaaagtgtacactgaccaagattatatatctttagatggtactagtggtaatgtatatggtgaaaaaattaagacagtagctccagaaataacagggcattttgcaacatttatggcttgggctgatgaaataagaaaattaaaagtaagaactaatgcagatactccaagagatgcaaaacaggcagtagaatttggtgcagaaggtgttggactttgtagaactgagcatatgttctttgcagaagatagaattatggctgtaagacaaatgattacttcaaaagatgttgaacaaagaaaaatagcattagctaaaatattacctatgcagaaatcagattttaaaggtatttatgaagcactttgcggtatgcctgtaacaataagattattggatccaccattacatgaatttttaccaagtgaagatgaagatattgaagcattagctaaagaaatgggaataacttttgaggaattaaaagctacagttgcagaattgcatgaatttaaccctatgatgggtcatagaggatgccgtcttgctgtaacttatccagaaatagcagaaatgcaaactagagctataattgaagctgctattgaagttaataaagaaaaagggtatagtataattcctgaaattatggttccgttaattggagaaattaaagaattaaaatatgttaaagaggttatagtagaaacagctgaaaaagttattgctgaaaatggtgttgatttaaaatataaagtaggtactatgattgaaattccaagagctgcattaacagctgatgaaatagcaaaagaagctgaattcttctcatttggtacaaatgatttgacacagatgacatttgggttctcaagagatgatgcagctaagttcttagcttcatactacgataaaaagatttatgaacaagacccatttgctaagttagatgctactggtgttggtcaattggttaaaattgcagcagaaaaaggtagagcgactcgtccagatattcatcttggaatttgtggagagcatggaggtgatccatcatcaattgaattctgtcataatgttggtttggattatgtatcttgttcaccatttagagtgccacttgcaagacttgcggcagcacaggctcaagttaaaaatccaagataaagagaatcatttaaaaatattaaataattaaataatttagaactgaaatttaaagtgatttaaatttcagttctattttgtgttgaagtattttgctttaaatgttcataatgactttttatagaaaaatatgaagtttagtaataatttaaaagatgaaaatcctcagaaagaatattcccttaataaggagcaattaaatctttgagaggatttttttttataaatttaatttttctattatgtttactgcaaaatcatactgatattcagattttgaacttgcattattaagcaaagtaaaaaatgaatttttattgcatttatgaacatttttaaaatagtcacgtgatattttccagtatttttgaggaaaacatatataggatattatataataaatatctgattctgtaagtggtgttatattgttgtacgttttaagaatatttaatgataaatccaaatcccattttgtattttctctttttaatagacgtctaagaaagtaggataaatctctagcacaataatccatcttgcatttatcaaagtctataatccatggatcattatcatcaggtataagaatatttttattaacataatctccatgacataatgatcgacttagttggctaggctctattttattagacatatctaaagaaatttttgctaatctaaaattcaaatcaaagtctgaaatgaatttttttgagaacttatctttatatttaaaagaatcatttgatgattttaataagtcttgaaaatgttttaatgttgatatgtagtaatcatcgaagccttcctttaaattacttcctaaaataggtttaaaagttctcgaaatagaatgtatctgagcaagtttttttatagataattcaatatgattcatattatcaaaagagcatttttctccttcaatccatggagttagtatgaacagcatatcattaaattgtgcaaaacgattgttgtctatggttggtaaaagtttaggaacgcgaattttatttctatagagccattcaatggctgaatatacatataataaatcatctaattcataataaactttttttagacaataactgttattgttgtaatcaactctgtatactgctcgttgtttttccgtatctttaaatttaattattgaaatttgagcattttgtaaattgaatttaggaagaacatacctttgtatagcttccggtgaaaggctagaattttgtaaagcttgaaattcactattcataaaaccctccttttataagaataatgtaaatctagtatattgttataaatttgttttattaaatgattgattttaagagttaactttatatatatcttttataacatggtcgccttggcaattttttatattaaaagtcaaaagaaaaaatggtaataaataaaagtatacgcttaagcttccattattaataatattaacgttgcttaattaatatacatagaaaagtcaagaaaaaaattaaaaaagtttatgttaaatatattattttaataataattgcaaataataaaagtatgtcataattagaggaatataatgataaatatagaatacataaaaaagaggtgatatatatgaatgtaagagaaaaaattgaaagttttgaaagcttgacactaataaatgaagcagcgttttcaaagaaatcattaggaaggataaaatatgaagaacctgatgatatgagaacatgttatatgcatgatagagatagaattatacaaagtaaatcttttagacgacttaagcataaaactcaagtatatataaaaacctctggagatcattatagaactcgcttaacacatacactagaagtatctcaagtagcaaggaatataggagtaggaataggattaaatgaaaatttaattgaagctatagccttagggcatgatttggggcatgttgcatttgctcataatggagaagaagtacttaacaattatttaaaagatggattcagacataatgagcagagtgtgagagttgttaataagttagaaaatgaaggtgaaggtttaaatttaacaaaagaagttataaatgggattcttcatcatagtggacttggaacaacaaaagatattataacccttgagggaatagtggttaaagtaagtgataaaatggcatatttaaatcatgacatagatgactcgatacgagcaggtttgcttggtattgatgatataccttgtgaaattgtcaaggtattgggcaataattcatcagaaagattaaatatattgataaaggattttgtaaatacatcaaataataatcttaaaaatgggatattggaaataggattaagtaaagaaattaatgaggcaatgattgaactgagaaagttcatgtttaaaaatatatatttgggtgacacattgaaagaagaaagaaataaggcaaaatttatattggaacagttaataggacattttgaaaagtatccagataaaatgcctagtgtgtatagaaaaatagttaaagaagaaggtcttcaaagaggtgttgcagattatattgcaggaatgagtgatgattattgtcttctactatttaataagatttttgtacccaaaatggttgtagattagttttttaaacaaatttatttgctaataaagaggaattttaactaaaataaagaataattatagatattgcagttatcaacattattaactagacaaattagccgaatatgttttataataaattttttatgaaaattagaaggaaaacaatgcataatgtcgaataatatataactgttgaaaaatgcagtagggagggagatgtctccttgcaaatacgtgaagaagtaattgaaagaataagacaggacaatgatattgttgatattatttcagaaaatgtaaggttaaaaaaatcaggcagaaactatgttggattgtgtccatttcataatgataaatctccatcgttaagtgtatcacaggataaacaaatatataaatgtttttcgtgtggagaagctggaaatgttataacctttgtaatgaaatataaaaaattaacattttatgaagcgtctaaatatctagctgataaagcagggattcctttagaattaggaaatgcaaaagaatctcaaattacaaaaaagaaagagttgctttataaggtcaacacagaagcagcacgatattatttttataatttgcagagaacttcttttgcaaaagaatatttcttaaaaagaggaataagggaagaggtaataaaacgctttggacttggctacgcacaagatagatggcatgatttaataatgtatctgaaaaagaaaggcttcaatgaaaatcttttattagaagcaggattaattttaaaaagtgaaaaaaaaggaaatacctacgatagattcagaaatagagtaatgtttccagtatttgatgtaagaggtaaagttattggatttggtggcagagtgttagatgattctaaaccaaagtatttaaattcacctgagacagtcgtttttcacaaaggcacaaatttatatggattaaattttgcaactaaaaataagttagaacaagattatatcattattgttgagggatatatggatttaatatctcttcatcagcatggaataacgaatactgtagcttcgcttggaactgcacttacaattaatcaagcaagattattaaagcgttatgttaataaagtaataatatcatatgatgccgatgttgcaggtcagacggcaacacttagaggacttgagatcctaaggcatgcaggattggatgttaaagttttaaaagtaccgcaaggtaaagatcctgatgaatttgtaagaaacaatggaaaggatgcttttttaagattagtagataatgcattgcctttgattgaatatagaataaagaaggcagcagaaggaattaatttaagagataataatgaactggtaaagtatggagagaaatttgctgaaatattggctgatttgaatcctatagagaaagatgtatatattaagaagatttcagaagaaacttctattaaagaacaggcgatatatgacttgctttctcaagtaatggcgaaagatcaaaaagaaaataactttatgaataaaaaggcagattatggaacaaaattatatgtagaacctggatatttaaaagcagaaagaacattaataaagttgatgtttaaagaggaatattttcaggaattaaatgaacttataaaagttggagattttgtattggactcacataataaaatttattcattaatattacaaggtaaaaacgaagatactagtaatataatatcgtacttagaaagtcgatgcgatgatgtagaaagttcaaaagaactaataaacatcaaagaacaagtaatcttagaatttactgataaagatagggttattaaggattatatgcaagaagttcaaagttataagcttaagaaaaagattgaagatcttaaaaaaaagcagagtattttagaaaaagaaggtaaattccaagaaactattgaaatagcaatggaattaacaagacttactaaaagtcttaaaaggggagaatgaggttaaaaggttataacggaaggaggcaattttattatggaacaaaaagcaaaaggaaaagctgcaaagactaaggatgataaaaatgataaaaacgttaaaatgtcagcagttaaagaattattagataaaggtaagaaaaatggatctttaacatataaagaaattatggaagctatggatcatatagatttaagtccagaacaaattgaaaaaatatatgaagcattagaaatgatgaatatagaaattattggagaggctaatgaaacagctgatgccgaagaggaaatagatttatcagttccagaaggaatagctattgatgatccagtaaggatgtatttaaaggaaataggtaaggttccattattatcttcagaacaagaaatagaatatgcacaacaaatagaagaaggtaatcaaagagcaaagaagaaacttgctgaagctaacttaagacttgttgtaagtattgctaaaagatatgttggaagaggtatgttattcttagacttaatccaagaaggaaatttaggacttataaaagctgttgaaaagtttgactatagaaaaggatataaattctctacttatgctacatggtggataagacaggcgataacaagagctattgctgaccaagcaagaactataagaattcctgttcatatggttgaaactataaataagcttataagagttcaaagacaattattacaagaattaggaagagatccattcccagaagaaatttcaaaagttatggatcttccagtagataaagttcgtgaaatacaaaaaattgcacaagaaccagtatctttagaaactcctataggtgaagaggaagattcgcatttaggtgattttataccagatgatgaagcaccagcaccagctgaagcagctgcatttacaatgcttaaagaacagcttataaatgtacttgatactttgacaccaagggaagaaaaagtattaagattaagatttggtttagatgatggaagagcaagaactcttgaagaagttggtaaagaatttaatgtaacaagagaaagaataagacaaattgaggctaaggctttaagaaaattaagacacccatcaagaagtaaaaaattaaaagattatttagattaagcacctgttttgggtgcttcttccttattttgaaaaatagtgataaaataatattttttgataataaatattaaaattactgattaattaaataaaagtggtgatgaaatggaactaagcaaaagactaaattggatattaaatataatggataaatgtgatgttattatggatgtagggacagatcatggttatatcgctatagaattaattaaaagaaatcttgcagataaggtaatagcctctgatataaataaagatcctttgaataaagctaagcttaatgtttctttagaaggattaagtaataaaattgaacttagacttggaggcggacttacaccagtaaaagagaatgaagttaatggtatactaattgccggtatgggtggaaatttaatcagagacatactagaaaatgatattaaaaaagtaaaaaatatggattatcttgtattgcagccagcacaaaatccagaagtacttagggaatatttatatatatcagattatgaaattatagatgaagatgtatgttttgatgaaggtaaatattatgaagtattcaaggtcaaatataaagaaaataattcaactaagttagaaaatattttttatgaggtaagtccaattctactaaataagaaaagtgatgtgtttaaagattacttatatgaaaaaattgataaatataaaaaggtaaagagttttataaaagataacacagaacatgcattatctagaaaaaaagaacttgatagcaaaattgaaataatggaaaatttgctgaaaaaattttaggagtagattttaatgagtaaagttattgatatatcaaataagattgaaaaaatggcaccagtgtttcttaaagaggattatgacaatgtaggaataatggttggagatccaaatcagaatattaaaaaggtgttatttgctttagattgtacaaatgaagtgattgaagaggctgtgcaaaataagtgtgatatgataatagctcatcatcctttattttttagaaaacctaagagtattgttaaaggggaacttcttggagataaagtttttaaattaataaaagaagatataactttatatgcatgtcatactaatcttgattctgcacaaaatggtataaatgaaactattgttaaaatgcttggatttagtagtgaggagattatagaacctcatgatagaaatgaaaataaatattgtggtataggaagaataataagactaaatgatagtataagtttagatgaagttatcaaaaggataaaaaacaatttaaaaattgataatctaagagttgctaaaggacgtgaaaaaattaatactattgcagttattaatggaagcggtcaagatttttttaatgtagcagaaagacttggagctgattgtataattactggagatacaacttatcattttgtaagtgattataaagaacttggagttaatataattgatgcaggtcattttggaactgaatttgtggtgtttttaaaaactcttgagtttttaaaagaggaatttaaggatattgaatttatagattcaaaaaaatcaaaagatccttatgaattttattaatatataatgaattgaattaatttacagaagttatcatataatatttcaatgagaacaatattatggagttttatatgagtaaaagtagcggtttttttgatgatataaagaaagactttaaaaatatatataaacacgggaaaaaggctgttaagggtttttcaggtggacatcgtcatgaacacgatgatgattgtggaaattgttgttctgggtatggaggtagaagacctaggtgctttggaggaccgcctttttttaagcctgggagatcaccttggttttatatattgttatgtcctaaaatgtgtgtgctatggttaatgcttttagtacttcttttatgtggagtaagcctttatggaataatagtaataattttacttggaattatttttatattgatttaaattaaaaataatttgattaattcataaaagtatggtaagataaagtctgcgagtgagacgtgcaatcgctgctagacttagatctaggagaggaaagtccgggctccatagggcagggtgctggataacgtccagtcaaggtgacttgaaggaaagtgcaacagagatataccgcctgaggaaacttaggtaagggtggaaaggtgaggtaagagcttaccagcgtgatggcgacttcacggctatgtaaaccccacttggagcaagaccgaatagagaggcattataggggctgcccgtcccgcctctgggtgcgtcgcttgagtttattggcaacaataaacctagatagatgattgcttaacacataacccggcttatggcttatctcgcaacatgtaaaatagacgattgaacgaaacaagaaaagttgattttctttattcttcagacggctattttttttattttagataattataatatgtatatatattgaagttttaccagtataaaatttaatgattcaatacatgaagagctatattatagtaccaataatatagctttttattgtattaatatagtgaaaaattaataatacgagaggatgaaaagtgtgaaatgtttttctaaatatagaaagcatatgttagcgggtattataatggtgcaaattttaactatgagtataccagtatatgcatatgaagtattttcaaactggaatgatgcagaaaagtatatatatgaaaatatgataaatagagaggataagataaaatttgtattcaaaggtgataaagataattttgtattaaatttaaagtcatctcttaaagatgcttattctcaagatgattatcttgaaagatcgtggactcaaataaagcctgaagcatataatattaatgaaggtattgaaacaactttaaatataaaatatttatgttcaaaagagcaggaaaattatattgataaggaacttatgaacattacagatgatattattaatgatgatatgtctgattttgataaggttaaagcaattaataattatattatgaatagatatgaatatgattatgatttaaaatcagtaagcgtgtattcttcgcttacaacatcaaaagcagtgtgtcaagggtattcaatgactgcttataaaatgtttaataatgcaggtattgaaaataggattgttataggaacagcacgaggtatatcccattcatggaatatggtaaaaatagatgaaaagtggtatcagattgacataactaataatgattcggaaaatattaataaatattttttagttaatgaccaatttttaatagataatgattatatatgggatagaaatatgtatccatcgtgtgatgaaaagtattcaaaaataaattaataatgtacatgtattagaaaaaaagtaacaaataaaacttaagtgaattgtaaatttatataagcacttaagttttttttattatagtttatatattcttacaaaaaacctattatagttttgtgaaatttccgtatagatattaaaggattacatatagtaaaataaacatatggaagatgtgaatctaaaaagcaaataagtttattaagtaaatcttaatagtgacatcatatagtagatttaaaatttcacataaaataaaaatagtatgtatcagataattataataaaaaacatagtattaattaattttgggagggcaaaaatatggcagatttatcattaagacatatttataaaatttattcaggagatgttacagcagttaaagactttaatttagaaattgaagataaagaattcatagttttcgttgggccatctggttgtggtaaatcaacaactttaagaatgattgcaggacttgaagaaatatctaaaggtgaattatacattggtggaaaattagttaatgatgtagaacctaaagaaagagatatagcaatggttttccaaaactatgcattatatcctcatatgacagtatatgataatatggcgtttgcattaaaattaagaaaagcaccaaaggaagaaattgagaaaaaagtaaaagatgctgctaagaaattagatattgagcatttattagatagaaaaccaaaagcattatcagggggacaaagacagagagttgcacttggacgtgctattgtaagagaacctaaggtattcttaatggacgaaccattatcaaaccttgatgctaaattaagagttcaaatgagaactgtaatatcaaaattatatcaagacttagaaacaacatttatctatgtaacacatgaccaagtagaagctttaacaatgggtacaagaattgttgttatgaaagatggtataattcaacaagttgatacaccacttaatatatacaatacaccaaataatttattagttgcaggatttatcggaagtcctcaaatgaacttaatgaatggattagttgttgaagaagacggaaaattatattctaaattcgaaaacaacaaggttttattaccaactgaaaaggctaaaatattaaaagatggtggatatgtaaataaggaagttgtatttggaataagaccagaacatttaagcgattcagaagcattagttaaagatgctgtagatgttacaattggtggagatgttgaagttgttgaaagaatgggtgcagaaagttacatttacttcaaatctggaagtagtagcatgactgcaaaagttgaaggaagcacaaaatttgaaccaaaagacaaaattaaattacatgttcaaatagataaaattcatatatttgataaagattcagaattaagaatctgttaataagttactattttgactgcatatatatttatgacatgaggtgaagagaatgacaggattagatcagtacttagaaaagatatataataattgtaaaataccatttaaagcatatatagatggaaaagttgtatttgaggctgatcctgtatacttccagtcagaggtggaagaagatgatttcttacttggttttagtgaagtcaaacttataattccaggtttgtttaaggagtctcttggacttttgaagttctgtattaaggataagttttgtgaatatagcatagattctgaaaaaataattttggatttattaaatggcgtagatatatcagaagaaaaaataaaagaaaatacaaggcagctaaaggaagattcttttctaattgtaataagtgtaaaggataaatcggaggaagctgttgaaatattaaacaatgtctatagtgatactgaaatactgatatttacatttaaagaatatgtaattcttcttggaagttttgaaaacattcaagagcatacttgcagtatttatgaaactttatatacatcaatttatatgaaatgttatatgagttatgtagaaatatcggattatgtttctttgaaaaagaactttgatttatgtagatataaattaaatctagcccataaatatcatgtttcagggaaggtttttaacatggatagtctaatgtttgaaagcattatagataatttaaatgaagatgaaaaaaatagaattatagctaagtttaatgaaggatttgaaagattagataatgatattatacagagtatcgatgttttctttgaattaaatttaaatcttagcgaagcatctaaaaaactatatgtgcatagaaatactttgatctatagactggataaaattcagaaatgtacttcatatgatataaggaagtttaatgaagcagttatttttaaagttgcctttgcaatatggaagcaaaaaagaaatatttagtatttaaatactcttatggaattttcataggagtatttttctttgataatttatataataaagtttaatgaaaaatagtttgattacattatatttacaatgggtatagattttatatagagtaaatgtaaaaaatacattgagaatttagttggtttttgataacataatattataaaaaagtaaaaataatacttaaattgaattattataaaatttttgaatataatattgatgtagctaatgttaaagtataaatgatcttttataaaatatttgtaaaaaattataaaaaatatagaaattatagtataatttaataaaaaattaatgaatgaacggtaccgttaccgaataaataaaattataactataggagaaaagtaatgaacattaaagatatagctagactttcaggagttggagtaagtacagtatcaagggttattaataatcacccagatgttaaacaaagtacaagagaaaaggttttacaaataattaaagatagtaattatattccgaataatagtgcaagaattcttaagcaaaacaatactaaaaatataggagttttagtaaagggagtatttaatccattcttttcagaaatgactaatattattggaaatataattgaagaaaatggttatacaatgatattacaacaaaatgattttaatctatatcaagatgttgaaactatgattggatttgtaaaagaaaaaaggcttcaaggagttatatgcctaggaggcaactttaccgaaatacaagaagatagttttgaagacatcaaagtacctgtagttttaacttcagtaaatacaatttcaaaaaaaggtaagaagtactattcatcggttggaatagataattctaaaagtgcatataaagcagttcgttatcttattgaaaagggtcataaaaagattgctttggttttaggagaagttaatgaccttggagtgagctggtggcgtttggatggatataaaaaagccttgggagaaaataatatagatattgatgatgaattgataataagtggagaatacaatagtggaacagcatatgaaaatgtaaataaactgttaaaaaaaagaaaagatataacagcaatttttgcattatcagatataatggcacttggagctattaaggcggctatagataatgggcttgatgtaccaagagatatatctattgttggatttgatggtatggatgaaagtaaatattacaatccaagtattaccacagtaaaacagcctaaaaagaaaatggctgagacaagcgttgagttattattttcattaataacaactgatggtgaaaataagcatgtaatacttgatacagaacttgtagaaagggattcatgttttaatatatagctatttattgagtatatgggaggtattgaaattggggatagaaagaggcagcggtattcttatgcatatatcatcattacctggaaaatatggtataggtacttttggaaaaagtgcatatgaattttgtgatttcttagaaaaagcaggacaaaaatactggcagatactgccgcttggtcaaactagttatggggattctccttatcagtcattttcggcatttgctggaaatccatattttatagatttagatatattaaatgaaaaaaatcttttagataaagatgattatgaagaaagaaattttggcgataacaaagagatgattaattacggattaatattcaatgaaaaaatgaaagttttaagaaaagcttatatgaattttaattcaaaagatgatgagtcatttgcaaaatttattgaagacgaaaagaaatggcttgatgattacagtctttttatggccttaaaatataaatttaattttatttcatggaattcgtggaataaagatataaagctaagaaaaaatgaagaaattgaaaagtataaagatgaattaaaagaagatattaattattggaaatttttacagtatgaatttttttctcaatggaaaaacctaaaggattatgcaaataaaaaaaatataaagataataggagatatacctatatatattgctcaagatagttcagatgtatggagcaatccagatatttttttattaaacaaagaaactttagaaccattgaaggtttcaggatgtcctccagatgccttttcagaaacaggacaactatggggaaatcctatttatgattggggttatttagagaagaccaattttgaatggtgggttgatagaataaaatcaagtttgaaactttatgatattttaagaattgatcattttagaggatttgaagcatattggtctgttgattatggggaaaaaacagctcagaatggaaaatgggttaagggccctgagatgaaactctttaacgttattaaagagaaaataggagatattgaaattatagctgaagatttaggatatttaacagaagaaacattggaatttaaaaaaaggacaggtttcccagggatgaagataattcaatttgcctttggtggtgatagtagtaatccttatttaccacataattatgaaaaaaattgtgtcgcatatactggaactcatgataatgacacagtaagaggatggtttgaagttacaggatctaaagaagagaaagaaaaagcagttgaatattttaaacttacagaagaagaaggatataattggggagttataagaggggtatggagcagtgtagctaacacttccataggagttatgcaggattttctaaatcttggaaatgaagcacgaataaataagccttcaactttagcaagtaattggagttggagagctaaagataatgtgtttacaaatgagttggcaaacaaaatatatagattaactagaatttatggaaggtgtgagtaatggtggataaagaaaaaataaaaaacggtattgaaagatatttaaaagtaaaacatggagttaaggtaaaagatgctaaagactatgaaatttttaatgcagtttcattgacggttttagaagaaattattgataactggaatgaaactagtgatacttataatagaggaagaatggcatattacttatcagcagaatatctaatgggaagagctttgggaaataatcttatgaatctcgggctttatgataatgtaaaagaagtgctttctgaaatgaaaattgatataaataaaattgaagaaatagaagaggatgctggtcttggtaatggagggcttggaagacttgccgcttgttttatagaatcggcagctactttaaatatgccattgatgggatatggaataaggtatagtaatggattatttaagcagaatatagaaaatggctttcagacagaatgtgaggacacatggcttaaatatggagaagcttggagtattagaaaagactctgaaacacaaataattaaattttcagatatgactgttaaggctgttccatatgatgtgccgataattggatatggaacaaaaaatataaatactctaagattgtggcagtgtgaggcgcttagagaattcgattttaatttatttaataatcaacagtatatagaggctgtttcagcaagaaataaagcagaagatatatcaagagtactgtatcctaacgatacagctgaagcagggaagatattgagacttagacaacaatatttcttttcaagtgcatcaatgaaagacattattaaaaagcacaaaactaaatatggaagtgatttttcggaattcgcaaaaaataatgtagctcaattaaatgatactcacccaacgatttctattcttgaatttttaagaatattagtagatgaagaaaatgttgatttcacaactgctttaggaattgcaaaagaattttttgcatacacaaatcatacaattcttgcagaagcattggaaaaatgggatataagacttatagatagattattcccgagaattcttcagatagcatatgcagttgatgatgctcttatgaatgaattaagacaaaaaggatatgatgaaggagcaatttggaattttagaattgttgcaaatgatgtgataagaatggctaatcttgctatttttgttggaagagctgtaaatggtgttgcagcgctccatacagaaattttaaagaagcatgaattaaataactggtataatttatatcctaataaatttcaaaataagactaatggaataactccaagaagatggttgagattatgtaatagtgagttgtcggaatttattactgatttacttggaaatgaagagtgggttaagaatttaagtcttttgaaagatttggaaaaatatatggatgatgaagatgttcttgaaagacttatggatataaaacatgaaaagaagattcagttagcagcttatattaaacaagaagaaggtataataattgatccagattcgttttttgatattcagataaagaggcttcatgagtacaaaaggcaattgttaaatgctctttatattttagatttatattatagagtaaaggaaaatccagatttggatataccaaagactacatttatctttggggcgaaagcatttccgggatataggagagcaaaaggtatagttaaatttataaacgaaatagcaagattaattgatagtgatgatcaagcatcgaagaagatgaaagttgtttttgtacacaactatagagtgtcatatgcacaaaagttattcccaggatcagatttgtcaaaacagatttcaacagcaggtaaagaagcatcaggtacaggtaatatgaagtttatgttaaatgctactcctacatttggaacttatgatggagctaatattgaaattgttcaggctagtggagaagaaaataattatatttttggacttagagttgaagatattgaaaagattaatcatagctatgaccctaaagcatactatagagataatccatctataaagagagcagttgatacattgataaatggaactttggatgatggaggaacaggatactttgaagatctttataatgcgttattagaggaaagagatcaatattatttactagctgattttgagtcattcaaaaagacagaagaaatggtatttgaagattatagagataaaaagaaatgggcaaagaagtgccttgcaaatcttgctaatgtaggtcagttttctagcgataggacaataaaacaatatgcagatgaaatttgggatattaaaccagatgcagttagataaatatataatgtaaacagtataagacttgtagattggtgaagcactatatctataagtcttattttaaatttgtggataatatttattacaaagttagttatgtttaataataatttattaaatatatagaagagtttaataaatatatcaaatcaaaatatagcatgtaagagtgataagaataattaaaagtttacatttaaaattaattaagatatgattattttgagattaaatttagattgtatataatttattaggttagaagagaggctgtaaattatgaaaaaaattgttgtgttagatggcaaaaccttaggaaatgttgattatattaaacttaatgaatttggacaagtagtttattacgatatgacatatggagatcaggttgcagaaagaataagtgatgcagatattattcttactaataaagtgattttgaaagaagaacagttgaaaaatgcacctaatctaaaactaatatgtgaaatggcaactggttataataatatagatattaaatatgcaagaaaaaataaaatagcagttactaatgttgctggttattctacaaatactgttgcacagcatacttttgctatgcttcttcacttatataataatataagttattttgatgaatttattaaaagtggggaatattctaaaagtgatatgtttactaatcttaatatgacttataatgatttatgtggaaaggtatggggaataattggccttggtgctataggaaaaagagttgctaaaatagcacaggcttttggagctagagttgtatattattcaacgagtggtaaaaatgtaaatcctgattacgcacaagttagttttgaagaactactagataagagtgatgtcatatctatacattcacctctaaatgaaaaaacaaaaggacttataaattatgaagcactatcaaagatgaaaaaagattctgtactcattaatgttggaaggggaccaatagttgtagactatgatctagcaagagctatagatgaggaaattataggtggagcggcattggatgtatttgatgttgaaccaataccacaagataatccacttttaggagtgagaaataaagaaagattagttatgactcctcatgttgcttgggcaagtgaagaatcaagaaaaagattatttgatgaccttcttgaaaatataagtgcatttaatagaggagaatttagaaatagggttgattaaaccataaagtgaaacttttcatgtggagttttatgctccagttaaatttagttgaacttatacctttaataggtataatacccaggagattgtagccattatcacctatttgaagaaaaacgagtattccaaatttacatttgatacaattgatttgaaatcatgggatgaaatgttacgatgctttctatgggataaataattaattaaagaaaagaggaataacttatgaagtatgcactagatgtacacacacatacaattgtaagtggtcatgcatattctactttaatggaaaatgcaaaggctgctagtgaaaaggggataaaagtattaggaaccacagaacatggatgtacaatgccaaatgcacctcatatatggtactttaataactacaaagtacttccaagagagatgtatggtgttaagatgctttatggtgttgaggctaatataattgattatgaaggaaatcttgatatggatgatgatacactaggaaagctagatattgttataggaagtattcatgatgaggtttataaagtgggaaatgctgaagaaaatacagctgcatttataaatgtaattaagagtggaaaagttgatattatagggcatttaggaaacccaacagttccagttaattttgaagaagttattaaatgtgcaaaagaaaataatgttcttattgaaataaataatagttcattcactacatctagaataggaagccttggaaattgcacaaaaattgcaaaaatttgcaaagaatatggaaatactattataataaatagtgatgcacatttttgtactaaaataggagagtttacagaagctatcactatgcttgagtctattgattttccggaaaattatattataaattcaaatccagatatgttattagctcttctaagggaaaaaggaagattaaaatagtgaatacttttaaaggtataatataaaaagaatagaaaattcttaaatgattattgagtaaaagttcaactttaaaattttagttttaaggttgaactttttttaataaaaaaaactaactcctaaatagaaaattaaatattagggtgaattgaaagttttgttgttctatggtgagagggttttgaaaaaatacagatacttggtagaaaaatgaaaataaataaactactcttagaaaataaaaaggaaccatattatcttccaaaaattggtataataatattgtgggggtgaaaggaaacatggtattagaaaatagcaatcataataggataatagtaggagtggttataattggtgtcattattctggcagtttatttggggacgtctgtattttttattaatagattttacttaggctctactattaattgcgtgagtgtttctggtaaaactgtaaatgaagcctatgatgaaattattagtaatgcaaaaaattatgaattgaagattaaagggagagatggatttaatgaaacaataagcggtgaggatataaaccttatatataatgatgatactgaagtgcagaaaattaaagaatctcaaaatccttttaaatggataatatctggattttgcagtaataattataaatcttcggaaatggtttcttttgatgttgataaacttaataataatataaataaattttcttgctttaatgcagatggtgtagaggaaccaaagaatcctatattacaatatgaagatgggaaatatagtattttaaaagaaacttatggcaataaattaaataaagaacatgttacaacagctataactaatgcaattgaatcggggaagacaaatattgatttagatgaagaagagtgttatgacagtccaaagtttacatcagaatcaaaggaaataaccgatgcaaaggatatattagacaaatatgtttcaacaaaaataacttatcacataggggatacacaagaagtattagatggtgataaaatacgtgactttttggatgttgatgaagattataatgtaagtgttagcgaagaaaaaattcgttcgtatttaaagtcgtttgctgaaaaatataatactattggaaagactagaaagttcaatacaacaggaggaagtacaatatcagtaagtggtggggattatggaagaaaaatagatgtatctgaagaagtgaaatatatactagatgctataaaggatgggaagactgacaatagggagcctaaatattcgcaggttccattttgtaatggaactgatgatataggcaatacctatgtagaggtaagtttatcaagtcaacatttatggttttataaagatggttcacttattattgatggaccaatagtttctggtaatgtaagtaatggatgtggaactccaggaggagtttataaacttgaatataaagaaagaaatgccacattaaaggggaaggttatagcacaccggtaagtttttggatgccgtttaatggtggaattggaattcatgatgctacatggagaagtagttttggtgggaatatatatgtagctggtggatcacacggatgtgtaaatgctccatatagtttagccaacactatatttaataatatagatagtggaactccagttgtatgctattattaattaaaaaataatagattaaagaaaaaatctacttcagttttaaatgaggtagattttttattctttatgaaattataatgatgtcaaatcattgataaccttgaagctttaaaaaggtgtatttgtaaacaaagaaatctaaagaataaaacaataatttgaattatagatgagaaaatgttgatgcagatatgctaaatattcaaaaacagtacgtggtgtgtcattaattgaaaatgaaagaaaagtgaagaaaaatcaaagggaatctaatataaattagaaaaaatagcatcatatgaaaagtttactttgttatattaatgatattataaaacacgtcgttaagacggcaagcaataaatttaaaactatataaaagctgaaattaatgaagcgaaataagttttgaaaaaattgttgacacatgtcaaactaagtgatatactgagtaagtcgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattataacttgctcaaaggttacttaatgagtattgattctgttcaattttgaaagactaagtctttcaaaagcgaagtctaataatgacaagtacgaggaagcaaaaaattatgaaatgagtagtactaatgtacatgaatgaataattttgaagttgacgaagtaattggctgtagtaggcaagcgaaaatgttctttgaaaattgcacatagattaatgtatataatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctaggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccaccattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaattaagaggaaactcgactcacttagttcgctgagtaagttcgattaaccaaatgtaaaatttggattctcacttatgtgcaattttgaaagaacaaaagttttttcaaaaagttaataaggaaactcactcagacgagctgaggagtacaagtttcttaattaaataaggaatacaaatcgttagcacgatttgcataagttcgcttgaccaaatgtaaaatttggaggctcacttaatctggtggtgatggcatagaggtaacactccttcccattccgaacaggacagttaaggtctatagcgccgatggtactgcatgggagactgtgtggaagagtaggacgtcgccaggtaagaataaagagtagttattataactactctttttattattaaaataattaatctaatataattattaagttatattagattaattataatttagttaaaagttaattattaactatagaacactttaattcatccacatgtccagcaactttaacttttctataaattttttttattattccattctcatcaataagaaatgtacttctttctatgccgaaacattttttaccaaacatagttttttcttttaatacaccataaaggttacatacagtttcttcttcatcagaaagaagaagaaaaggaagatcatacttttcaataaatttgtcatgagatttaatggaatctctgcttatacctattataattgtattattatcagtgaagtcttttattgattctttaaagtcttgtgcttctcttgagcaaccaggagtattatctttaggataaaaatataaaataacttttttatttatataatcgcttagtttatgttcctttttatcagatccgagtaatttaaaatctggagcttttaatccttcttctattaacaattctttcataaaatacctcctattattgtggataataattattatataataaaaaataaaagaaataaagatatataaagaataaatttataaatattttaagaaatatgtaaagtggtattattttaaaatatgaaagataagtgtagtatttcaataaaaatatacatatttctaaaatagatatacatattaaaaatatgtatatctatttttatatagaaaacactcaaatctctaaagctaatgaatatatatattaacagggctcaatatataagaaaagtggtgagttaataatgtatttgaatagtaaaagaatagtaactatagagaaattatttataaatgctatagtatatagttttgataaaaataatactacatatgaagctatgggaataggaaatggaaaaatattatttttaggtactaagaatgatgctatgaatttattggacaataatactgaaataatagatttgaaatataaagtagtaataccatcgtttgtagatgcttatgtaaaaattcctcaaaaattaattatgaataaagatgatttgagtttatttgaatgtaagaatttgaaagagtatgagagggttataaaagaatatattaataaacatattgataaagaagtaatatatggatgtggatgggagcttgataattttataagttgtgataaatttcataaaggacctaataaaaaatattaaatgatatatgtgaaaataaggcaatcattttaagtgatgttactggaaaaatgctatggcttaatgataaagcttttgagcgatttaaaattactaagaatacttatgagcctataggtggaaaaattgaacttgatgaagatggagagctttggggaattcttaaagataatgctgtaaatatcattaatattaatgaatttaaaacttataaaaataaagattatttaaattctttgatggaatttcaaaaaatacttcattcttatggaataacttcaataggccttgtagaaaataatttttcaaaaattccttttgatgtttatagaatggctgaaataaaggataaattaaaattaaggatagattatggtgttaacatatttccatacgaaataggaagaaagactatctatgaacagcttcatgacttaaagagattaaaaataatatataaaagcaaatattttgatattagtagagcatgttttgaagctgatggattaatagagatgcaaagtgcattcctatttaaaccatatagaaataatcaagatgattctgactatacgggtcgctttaaatgggatgttctagaatttaaagaaggaataaaaatggcaaatagactagatttcaatgttataatcgaagctataggggataatgcatgtaaagtttcaatggatggaattgaatattcacagaaaaataataattataataaatgtagaaattcaatagttcatttaagcctgattactaaatattatttaagaaggatgaaaactttggaattaaatgcaataatacatccattttggtattatcaaaatagtgttaggacaaaatatgaatatgagttcataggtgaagatagaattcaaagattatacccatataaatctttaattaataacaatatacttatagcatcctcatgtgaatactttaatgaggaaggtattaatcctattaaaggagtatggtgttctgttacaagaaatctctataagtttagtgatgaggataaatcagacaagaatataatgatggatcctaagtataggttaaatccagacgaaagagtaactgttatggaagcattaaagagctttactattgatgcagcatatatacttggaagagaaagttatgttggaagtattgaaataggaaaaaatgcagattttattgtattagataaaaatatatttacaagtaactttgaggaaatatcagatattaatgtgtgcagaacatattttgaaggacaattggtttataataaggaataaaatattaaaaaattatattataaaaatgtaaaactctcttaatattttcttaggagagtttttttgtatataattattagaggactaaaaaattaaatatacgtctatattgtgttaaacctgaaaggatatgaattaaagatggagaacgtattaattactggagcaaccagtggtataggatatgaaataacaaaaatttttgcacaaaatcaacatgatttgttattatgtgcacgtgataagaaaaagcttatagaaataagagaaaagttaattaatgaatataaagtaaaagtgtttatattttcaaaagatttgagtaaagaaaaagatgttgaggaattatatagagaaataatggagttaggaattaatgttgatatattaattaacaatgcaggtgctggatatgttggtgaatttattaatgaaagctatgatagagataaaagtataatgtctcttaatatgaatgcagtaacttatcttactaaggtatttgcaaatgaaatgataaaaataaataaaggcaaaattttaaatgtggcttcaactggatcatatcatccaggtccatatactgctgtatattatgcaacaaaagcatatgtattatcttttacagaagcacttgccgaagagatgaaggagtataatattacagtttcagcactttgccctggagcaactaaaacaaatttttctaaaaaggcaggaaaaaagataatgcaactgcaatgagtccagaatatgttgcccaaaaggcatatgaaggtttaataaaaaacaatacaactataataccaggatttaaatacaaaatatttgttttgttaccaagaaaaataattacaccatttataggaagatatcagagaaaattgaaaaacaattaataaaagcatatctgttaatagaaaaatatattagcagatatattttattattgtagtttattacaaaaggttatatattttacattttatagaatgagtataaaggttcctaaagtaataaaaataccaccaagtatagttttaaaagttatagcttccttaagtattataaaagctaaaaacatgcttattacaacactaaatttatctattggaactacttttgaagcatctccaagttgaagtgctttatagtaaaataaccatgaaagtccagtagcaataccagataaaattagaaatatccagcttttaatacttatatcaggtatttgtgaatgagttcctgtaaaaaatacaattccccaagccattattagtacgactatagtacgtattgcggtggctaggtttgaatttatgccatctatccctatttttgccaatatagatgtgactgctgcaaaaaaagctgataaaagtgcaaaaataatccacatatgattatctcctttgaattttaaaattttaaagacctccttaaattttttattttatatcaataataagtatatatatatatagataattattatcaatagaaatataatgtttgattttgaaagtaaaaaagtttaaaatataattcaatatggtgtttatgttaaggtacaaaggaaatatattattaaaggagaaaacaatgatattattaaaagaagaagcagatagatgtctgttatgtaaaaaaccaaggtgcagggaaaattgtcccatagatacacctattcctgaagtaattagtttgtacaaagaaggaaagattcatgaagcaggtgaaatattatttaataataatccattatctgttgtatgtgctttagtatgtccacatgaggaccagtgtaaaggaaattgtataagaggaataaagggtgaacctataaaatttcatgaaatggaagcagaaatttctgggaaatatttagatgatttggatttagaaaatgtagctaaggataaagatagaatagctattattgggggaggtccagcaggaataacaattgcatttatattagcacaaaagggatataaagtaacaatttttgatgctcatgataaaattggagggttttaagatatggaataccagaatacaggcttccaaaatcaattgtagataaactagaaaataagcttatagatgttggggtattgataagaccaaatactattataggaccagtaattacactcgatagattatttgaagatggatataaggctgtttttattggaacaggtgtgtggaatccgaagacattaaatattaaaggggaaactttaggaaatacacactttgcaattgattatttaaaatcacctagtgtatacagacttggtaagaaagtagctgtaattggagcaggaaatgtagcgatggatgcagcaagaatggctaaaattaatggtgcagatgttacagttctatatagaaaaggctttgaagatatgactgctaccaaagaagaaataagggaagcaaaagaaaatgggattaaatttaaattatttagatctccattagagattaaagacaatggtgtaagccttgcatgtacagaaaatatattacgtgaagatggaaaagtgatgacagaaattattgaaggtaaagaggaattttttgaatgcgattcaacaataattgcaataagtcaatcaccaagaacgtatattgtttcaagcactgaagacttgaacacaaataaatggggacttcttgttactgatgatagagggcatactactaaaaaaggaacttttgcatctggagatgtagtaacaggtgcaaaaactgtagttcaagcagtagttcaggctaaaaaagtagcagaatctataattgaatattgtgaaagtaattaaataaatactagacaaaggaaattcaaaaaaatgattttcctttgtctttttattatttaatattattatctatgagtatcatacacaaaaaagaatgaattaacaaaacagtaaaaatatgttaatataatgatattaatttattagatgaatggagttgtgagtaatggggttttttaaaagagaggaaacgcaaggattaatgatcaacaaaaatgttaatgaaaatattattggtaatgatgtgaaaaagattagtaaatcaagtaaaacattgtctttatttaaagaagatacaataaagtatgttattgaaaattttccaagtatgtcagaagaaattcaaagaggacttttggaagtatctgtgatattagaaaatacaatagaccatatagaagataaatcaagcaagcttataaaagatagtagaaattttaatttaagtcaggaatatagagatacgtgtatttctatatatgaggttgtagaaaatataaaaggctatgtaaaatggatgaaagatgaagggaataaagaaacggaaatcaaagaggataatattaaagaaaatgaagaagaaataacttcacaagatgatataaaattaaaagaaatatctgaaaatgaagttaacactgttaatgttgaattagaaatatataaagatttttcaggaagagaaccaaagggatttgagattgataatgatattatattagttgatgattgggatgatttattggttaaaacagcagaaattttaactaaacagtataaacaaaataggaatagtgatattcttataaaaccagttaaagtagttgaaaaaaaatcacctcagaatgaatttagagatacagtcattgaaatgcttagtgaatataaaataaatttaagggattttaaaataatagttaggtagtattttatacaaagttgaaagttgacaattaataatcttctattatagttgttatttattgaaatttttcattgtcaaactttcaacataataaaactactgttttttattttctatattaaaatatatattgacaatatgcatatatgtatatataataattttaacaaattaaattgagtaaaattaaatttaaacatatgtatattagaaaaatataaagccaagatagatatatagtagtgcatattaataatagaaaataaaggagagagtttaatgaaaatagtaaatagtaacgaatttagaaatgaaatttcagaaggtgttgttttagttgatttctttgcaacttggtgcggaccttgtaaaatgcttggacctgttcttgaggatttaggcaaagaactagaaggaaaagctaaaattattaaagtagatatagatcagtctggtgatttagcagatgaatttagaatttcaagtgttccaacaatgatgttatttaaagataataaaattgttgatacaatggtaggatttttaccaaaagaaagaattaaacaagttattgaatctaacctataataagttttattaaaaattagttatataaaataaaaaatatattaaataattatagatacctagttttatattaaggatagttaaaggttaagtgttttaactattataaaataatagggtatctatattttttgaatgtaaatattcattataaatactatattatgatagtttagtaagtagttaagaaaaagtttatttaagaacatatatttaaggagggaatggatgatgagtaattttgatgatttaaagttggataatcagctatgtttttcactatatgctgcatcgagagaagttattaagctctataagccatgcttagataagtttaatttaacttatactcaatatgtggctatgcttgttctttgggaggatgaaaaaagtactgtcaaagaaattgggaaaaggcttcatttggactcgggaacactaacaccattattaaaaaaaatggaaagtatggagcttataaaaagatatagagatattaatgatgacagagttgttatagttgaacttgcagagaagggaagaaatcttaaaaacgagataacatgcgtgccaaaagaaatggtatgtaagataaatcttgaaaaaaatgagataaagagattaaaggatgaacttgataatcttttagaaaagttaaaggaataaaaagtttaaatacaattataatagttatagaagagaaattggatatataaaattatatatataatattaaaaaagcatattaatagtctgtcgataattataaaaaatattgacaagtttttaaaataagtgtattataaattcaaagttagataaaaatcccatgaaaagaaaaagtaagtaataattattgttctacagaaagttgacggatgatgaaagtcaatgtgcagtgtattactgaaaatcatcttggaggagtgaaactgaatttgaaaaagtaagtttcaacggaaattccaccgttacaaggaaagcgtattaattgtacgtaactgagagctgcaagagttgattatatgtatatatgttctttcttttgtggaattagggtggtatcgcgtgttaacctcgtccctttgttataagggatggggtatttttttcgttcattaataaatctaactaatattgtattaattaaaatcaagtgattgaattagaagaaaagtagtatagtagggaaatgaaaattaaaggggcctaaagtaattttcagtaattttgtagaaatcatttgatgttagttaattattaacaagaactaatgttaaattttcatatatgaaaagattaagatttatggtttgttagttattaattaagaataagaggggatattaattatggataatttatcaaaaaaagatttgagactagtaagtttaatgttattttctttattttttggagcaggaaatttgatttttccaccatttttaggacaatcagcaggaactgcaacatggatttctatgttaggattttttattacagcagttggatttcctgtattaggagttatagcagttgctaaatctggaggactaagaaatttagcacaaagagtaaatccaatttttgcaacagtattcacagtattgatttatttatcaataggtccttgtcttggtattccaagagcaggaagtttaccttttgaaatggcagttgcaccttttcttaaagatacaaatataagcatgatacttgctaggtttttatatacacttgtattttttagtgtagcatactggttatgcttgtcaccatcaaaacttgttgatcgtataggaaaatttttgacaccaatattattagcgcttataacattagtttttgtttcagcaatatttaaaccattaggaagctatggaattgcaactggagattatgcatcctcaccatttgtaaaaggatttttagaaggatatcttacaatggacacaatagcggcattaaattttggtatagtaatttcatttgcaataaagtctaaaggtgtaaaatctgaaaaggcagtagtttcttgctcaataaaggctggtattattgcaggtgctttattaattgcagtatattcaatgttatgccatcttggcgcaactagtggaggaagatttggaggaactgaaaatggagcacaaactttaagcaatgtaatgacatatctttttggtcaaccaggagcaatacttttagcagtaatatttacagttgcatgtttaactacatgtgtaggacttataacttcatgtagcgaatattttgctagcttaaattctaaagtaaaatatattacatgggttagaattttatcactttcaagtatgatcctagctaatatgggattgacaaaaatacttgcagtatcagttccagtattaaatgctatttatccaatagctataatgcttatagttcttgcaatattagataaactgtttaaaggaaataaaatagtgtacttattaacaatattatttacaggaatagttagtgttattgatgctttaagtcaagcaggttttaatattgaaattttagtgagatatttttcaaagctgccattatattcacaagggttaggatggatactaccagcattaataggaattgttataggtacaattttaaacttgtttaaaaagacacaattagattcagaaaatatatcagcggaagaagcttagaatatagaaataaaagacttttctttgaaaaataattcatgaaaagtcttttattatgaaaaaaactgattataataaactaaagacaaatatattaatacatttgaaatgggtgaataaaatgaaaaatgttaataagattatagataaaataaagcaaaatgaattttttaaggggatagatgataaaaaaatagaaatgattatttcagaattaagtcatatttctaaggaatattcaaaaggacaggtaattgccaatgaggaggaggtttgtaaaaatctaggattagttgtagatggaattattgaaatacagagaatatactcaagtggaaaacatatagttcttaaacgtatgggagcaggggaagtttttggagaagccataatattttcagataaaaataaatatccagccacaataattgcttcttcggattgtataatatcttatttgaaaaaagaagatattattaaactttgccttaatgaagaaataatcttaaagaattttataactttattgagcaataaaatttttatattaaatagaaaaataaaaaccatatcttttaaaacaatacgacagaaagttgttaactttatattagaacagtcaaaaagtcagaacaataaaactgtaattttgaaaataagtaaagagcagatcgcatctttacttggaatacctagaccatcactttcaagagagcttatgaagcttagagatgatggacttattgaatttgataggaacaaaataagtattataaatatagaaagacttgaagaagaacttttagaatagaaaattatttattattactcaaataactctatggaaatattttacaaaatgcaaagtataatgtaaaatattaacagtgaaatgaaagcttatttataagtttaaaaatcaaatgaatggagtaataattatgaaaaaaatactaatagatatgatttgcctaacactaaaatatatgcctcaattattatatcctaataaaaaaacatgtaaattaaaaaaagcagttttagaggattataatacaatttatggtgaagcatcaattgatgatattttagaaaaggaagaggagttaactaatgaagtttatgaagaaaaggctatatatagtataaatttaggatgcggaacattaaatgactatcaaattatggatgcatataaggtaaataaggaaaatttaaatgacattaatacattcttaaaaggaaaagatttaagaaagaaagttgatataaaaaaagaagctaatgcagctgccgtagctttaataagaataaatgagggaaatggtactatacttaattataaaaagtttcaaattagtatattaccaatttaccttcaaactattaatgataatataaaaaaatatagaattaatatgaaaaagaatttaacaataactgaaattaaagaaataggctctactttagctataaacataagtagtggaatagataacataaataatggtataggaaatagaaaggattatgaaataatagggatcaataatttaagcaaaaaaaatataaatgatataaataacttcttaaataataaggatttaaaaacccctaatatgattagaaatgaaataaaacgactttttaatgctttaagtaaaatatcaagaggaaatggaactaataataattaccaattaatagggatgaaacttgaaagtaaaaagattaaaattattaattctgtattagaatgtgtatataaaagggacaagcgggatcttagtgtaggagacataatcaatataagtgaaaatattatggataattttatggctataaataattctagtgatgaaaaatcaaaaagaaaattgattataacggattctttagaaagagaagcattgtaaatttaataactaattagtatagaatataatttagattaagaattatattctatactattacagtaataagctttataccaatatcattaattttttgtctccattgctcaggaatgttgctatcagtaataattgtatcaaaatcacttaaatcagcaaaataagaagatttgacaacaccaaattttttagaatccactagaagtattttttcaacagaggattttattattgcttgttttgttaatacttcataattattagaacatgtaacccccagggtttcatggattcctgacgcagaaacaaaaactttagttgcgcgtgttttttctattaatgatattccttctggactttcaaacatcatagtattttgatgaaagtaaccaccagagaaaataagattaatatttttctttttagatagagccatcaaaatattagtattaaatataagagcactgatatttaaattattatctataaactgtgctaatttttctgtagtcgttccagtatcgattattattacatcatcttcttgtataagattagctgcagctttacctattttaattttttcatcttcatttcgtattacttcattttcaatgtcataaaatgattcgagtttttctatgttatttgaaggattataaatagcggcaccatatacattattaattatgttatttgattttaatatttctaaatcacgtcttattgtcatttcagatactccgagagttaaagataattcttttacagtagcaccgtttttttcctttagaatatctattattttatttgcacgctgcaattttttactcaaacttatcaccttattctttgaatttattgtttatattctaacattttttattaaagaattaaaggggaagtgaatatactgaactaattattgttaaaataagaatatgtgctgtattctataaataacaagtattgatacttgaataaaatattaaagtatttttagttgttgaaatttaatagttgtagtatataacaaaaaaatgtttgaactttaacattttatgttgaccttataacaaaatggtattaaaattatcacatagagagaaaactttagtataaagaaaagaggtaaaataatgaataaagtagaaattttaggtcatgtagatcacacattattaaatccagttgcaacttgggaagatattcaaaagatatgcaatgatgcaattgaatataagacagcatcagtatgtataccagcatgttatatatcacgtataaatgaaaaatatccagaattaaatatctgtacagttgtaggattccctttaggatattcttgtactgaagctaaagtagctgaaactaaaaaagctttagaagatggtgcaaatgaaatagatatggtaattaatattactgatgttaagaataaattatttgataaagttacacaggaaataaaagcactaaaagaagtatgtggtgataaagtattaaaagtaataatagaaacttgttatttaacagaagaagaaaaaatagctatgtgtaagtctgtaactgaagctggtgctgattttataaagacatctacaggatttggaacaggtggagctactattgaagatgttaaattgtttaagaaacatatagggccaaatgtaaagattaaagcagctgggggagttagtactgttagtgatcttgaaatgttcattaatgaaggttgtgaaagaattggaacaagtagagctgttggacttttaaaaggagaagcaacacaagggtactaaaaagaagattttaaaaagagtaattaacatattgaaatagtattataatactatttcaaattgttaattattaaaatatagcctgagaaaacgtttcctaaagtgctatatattttgaaaatgcatttaaaatgataaaattgaatatatgagttaatagaaaagtgagggattaatatgcgttttgttgatattataaataagaaaaaagaaaaatttgaacttaatgatgaagaaatacaattttggattgatgggatagtagatggctctattccagattatcaaacaagctctttgcttatggcaattgtattaaatggaatgaatgatagagaaacagcatatttagcaaaggcaatgatgaatagcggagatgttattgatttatcatcaattgatggaataaaagcggataagcattcaactggtggagttggtgacaagacttctatggctcttggaccaatggttgcagcatgtggtttaaaagttgcaaaaatgtcaggaagggggcttggacatactggaggtacattagataaattagaatcaattgaagggtttaactgtttcttaagtgaagaagagtttaaaaatcaggtacaaaaggttggaattgctataataggacagactggagatttggttccagcagataaaaaattatatgcattaagagatgttactggtacagtaaattcaattccattaatagcatcgtcaataatgtcaaaaaaacttgcgtcaggatcggatacaattttacttgatgtaaaatatggagaaggtgcttttatgcataccatagaagatgctgttgaattagcacaagcaatgatttctataggaaataatcttggaagaaatacaatggcaatgatcactgatatgaatcagcctcttggaaatgcaataggaaattcaattgaaattattgaagctattgaaacattaaaaggacatggaccaaaagactttacagaactttgtatgcaggcaggagaaataatgcttatacagggaaagattgcagaaaatgaaaaggaagcaagaaaacttcttgaagaagctgtaagctctggaaaagcttttgaaatgtttaaaagcatggtgaaggctcaaggtggaagtgtagaaatgatagatgatacttctcttcttccaaaatctaaatatgtaacagaagtaaaatcagaaaaagacggtaatataaaggtgcttcattcagaaaaacttggaatacttgcaatgcatcttggagctggaagagcaactaaagaagatattattaatcatggtgtagggctaaaaataaactgtaaaaaaggtgatagtataaaagttggagatactatatgctatgtatatcatgatgaagaacttaaagaggattggttaaagcaacttcaagaagcttttgttattacagatgagaaagtagatataagtccattaatagaaaaaatattaaaatagtgtttatatttatagattatgactgcttaaaattgaagcagtcatttctatatttatattattttttctactccatgaagataactttgaatatgattaaagattaaaggttttgtactttctaatagtgaaagttcatcaattagaagcaataattcattagatattttttcatttttatctacagaatcttgaatttcagaaatattgttttttagtgaaattatattgtttatatcatttgttatcttagatgttatacttttattactactttctaaaatattaaaatttgatattgttgtatctatggatgagttagtgttatccatactttgcgtaatttcatttactgagttttttattaaagttagagtttggtgaatatttgttaattgtttatctatttttgctgaagtttcttttgtcatttcagctaagcttcgtacttcatcggctacaattgcaaaacctcttccagcttcaccagcacgtgcagcttcaatacttgcatttagggaaagtaaatttgtttgttcacttatttcatttatgtaagagagatttgagcttaccatgcttacattatcttcaagaatatcaaagctttttttaaaatcagtgattccctcatttgtatttttaattgttgatttcaaagaatcaaaacttttgttgcagtctttaagatgtgaattatttctatttaaatcatccattacttcagttaattcattagatgattctattattttagtatttattacagaagtagaatttgatattatttcagctgttgtattcatttcctctgaggagtttttaattttaaaaatactttctataatagtatgttcgctatctaataatttggatacgcattctttagttttagaaatagtatgaataagaacatcttttttatcgttgaatttattaggttctaaagaatgttttagatctgaattggatttagattcatgatctgtagaaatagagtgcttaattttctttttaaaaaacataattattattcccccgattgttaaaaaatattatttgaataagcaataagtcatagtttgatttgcatgagaatcacaatattgctcaccataagaagtcatacagataaattctccaaatgtactaagatacttttgaaagttttttattgaattttctttttcaaaaagatgtgttcggaatatacagtttatgaaaattccccctagataactatcagcatattttttggaagcatcttcccataactttatatagttcataggattgcatatagaaatgtaggattcttgaaaaattcgtccatataaattaaaactattttggtcattattcataattgatgaaataaaatatctattaccaactattctagcaaatggatgatagataaattcatctttcatatgttccttggatatatttaatgagttacaataaaaatctacagcgggtagcccatttatttcatgaacctttctttcaaaaagttctgactttgatattatgccttttatttctgtaggctcatatatattttcacaataatattcaatttccataggagttgtaatcatacataaagcagaagcatttgaagcagactctccatttatacagacctttgtagataaaaaatcaccattatctgcagaacttcctcctataagtggaatgtcgggtaattcatttgtaagaactgttagtacagattcttcagcaaggcttaatccatcagtaaattcaagtaggactgaatgattcttcttatatatatcttttaatgataaaatttctttataatatgaaattatattattttttatatcttttaagagcaataattgaacatcttctatttttattcctaaaaaacttacagaatagtagtcaaaaatatttttatttatatttttataacttgaacatccaatactgttttcataattttctgaaatggattttccaatttcatcaatccattcaataggagaaaagaaaactattaagtaatcctttggtattagtttttttatttcgtctaaattaaatttgctttgagttaagctaattacttgcttcatacataaaaccaccttttgtaatataagtatttgttaattatatcataaaatatctaaaaattattttattgtaattatttagataaaataagacaaaaagtgataaaattatataaagaataaaacatactctgtaacttatgttacagagtatgtttttaattacatgtataatataaaaatgcaaatactaaatatgaatttataaaagataaaaaggagaagtagcatgagtttatttttaggtaagattcattactggttatttaataaaatagtttggtttgaaaatttagaaagagaaatagtaaaattagcatcatcagtagaaatagatgttaataatatagaaaaagaaatagaaaaaaaatatggcaaaatgcttccaaatagacctttagaagaaattattgatacatcgaacatacatggatggcttcaagaaaggatacacaatgcagaaggtcgaatggcatcttggactagagctataattgtaaatgatgttaatgatgtggtgaaaatacagaatatatatataactcaaggaataaaggctgctaatgaagttaaaaacagtaatacatcatttgatactgcatatgaaatatatagtaaaattaatgattatattttagatggaatgccatgtgatagagttgatgaaataatagtaaatgaagatgatataattacatggaaaaaaagaatatgcgttcataaagaaatatgggaaagagaaaatatagatgttgaacagttttataatttaagggatttgtggattaaagcatttgttaacactataaatgatcagtttaaatatataaaaaatgatgatggaactttttcaataacaagataatgaattggtaaaaacatatttataaatttgaaaaacaggctgaatattatatttagtctgtttttttaaattttttttgagttgtaacatatgttacatactgagtttggaattagggatacaatgagtacatagctgatgaacagcaaagagatactattaatttagaaatacatagttattaattaattaaaattaatatttataatattggaggagtttattatggaaaataatatgttttgttttcaatgtcaagaaacagcaggaaataaaggatgtacaaaagttggtgtgtgtggtaaaagtgcagaacttgcaaatatgcaagatttgttaatatatgtaacaaaaggtttatcagaagttacaactaaattaagagaagaaggaaaggaagttagtaaggaattaaatcactatataactcttaatttatttactacaataacaaatgcaaattttgatgatgaagtattttatataagagttaaagaaacattagcaaagaagaatgagttaatagaaaaactttcaagtaaagaaggtttatcagaagctgcagtatgggatataagttcagataataaaactggtattttaggtgcaattaaaaatttagtaaatggaaataaagatgctgaagaaataaataaaatattaaaagataagtcacaatctaatgaggttggagttttatcaacagaaaatgaagatattcgttctttaagagagttaattacttatggattaaaaggcttaagtgcatattctaaacatgcaaatgcattaggatatgataatgaagaaatagatgcatttatgcaagaaacattagcaaaattgttagatgatactttaagtgttgatgatcttgttgctttaactttagaaactggtaaagttggagttgatggaatggcacttcttgatactgctaatacttcaagttatggtaaccctgaaataacaaaagttaacataggggtaggaaagaacccaggaatattagtatcaggacatgatttagcagatattgaacaattattgatacagacacaaggaacaggtgtggatgtttatacccattcagaaatgttaccagctcactattatccacagttaaagaaatacaacaatttagtaggtaattatggtaatgcttggtggaaacaaaaagaagaatttgaatcatttaatggaccaatactaatgactacaaactgtattgtaccaccaaaagattcttataaggatagaatgtttacaaccggtgctgctggttttgcaggatgtaaacatattgaaggagaagctggaagtgtgaaagatttctctgaaattattgaacttgcaaagacttgcaaagcgccaactgaaattgaaactggtgaaattattggtggatttgctcatgaacaggtatttgctttagctgatacagtagtaaaggcggttaagtctggagcaattaagaagtttgtagtaatggctgggtgtgatggaagagcatctaagagaaattactatacagattttgcaaaagcactacctaaagatactgtaattttaacagcaggatgtgcaaagtataaatataataaacttgacttaggtgatataggaggaattccaagagtattagatgcaggtcaatgtaatgattcatattcattagcattaatagcacttaagttgaaagaagtatttgaattaagcgatataaatgaattacctattatttataatattgcgtggtatgaacaaaaagcagttatagtacttttaagtcttttatatttaggagtaaaagaaattcatttaggaccaacattaccagcattcttatcacctaatgttgcaaatgtcttagttgaaaactttggaattggtggaatttcaactgtagaagaagacatggaaatgttctttggtgaagaagtaaaaggtgcaaagtctgaaaatggagttataacaaaagatatgattatagctgatatcgtaaatgcagatgctgaaaacacaaaaatattaatggagtttggtatgcattgcataggatgtccatcttcgcaaatggaaacattagaagatgcatgtgcagtacatggactaaatgtagaagaattaattaaaaagttaaataaataataaacaataaaaaactcacttggatttttttaaatatcaagtgagtttttgttataataagttaaatatttttataataaagttattatgaaatatctattcaagatttagttttttagtaagaacatagtttgttataaagaagtatatactgaaatatattaattctaatacaattgatagtaataatattccactgaacattcctgatgaaggttcagtaaacattgatatgtgatttgatgagaatatatacacagctattgaattaataatgtttgatagtatacttaacactataaaagcaacaaatgacataaggattttagatttactgaataaatgtcctattgatattgaagcataaatcatagtaattgaagttattaattctacaaatccaactataaagaattctattgctaatataaaaggtgtaccaccataataattaaatacatctcttaatactggaatgatattagagaagatatctcgaacactatctatcgttacaaatagaagaataattgacataaatgctacaaagcagcttactattgtccaaattgcagatgtaagtattttatttattatatttaaataaggctttacaggaagggtattcattaaataaccctcatccccaagaatgtttttgtaaaatctttgaacgataacaaaaaatgtaacaacaaagacagcagccattgtacatccatatgcaaatacacttaaaatattagctatgccaccaatagttccgaaagtgttattgatagtttcatctaaactgcttctgaaaagcaatctatttattaatgcaaatactaaaagagcaccataaagaggtagaaggattcttccagtagctttaaattcatatttaattaatttacctaacatttaaatacctccctaaatagagcatctacactcttaccttcattttctctaatttcatcaacactttttgataaatatatatctccataagatatgaaaataacatcatcaagtattctttcaatatctgatataaggtgtgtagatataattattgtagcatcttcactatagttatttattatagtatttagtatatagtctcttgctgcaggatcaacacctgcaataggttcatctaaaagatagagtttagcttcacgactcataacaagaataagctgaaccttttctttagtacctttagacattgtttttaatttatcatttggatttatatttaatttagctaacatatcataagctttgtctttattaaaatttttataaaaatcactaaagaaatttataatatcagagactctcatccaatcattaaggtaagttctttcaggaagataagatattatttcttttgaatctacacccggttttttaccatcaatcaaaatttctccacttgttggggtaaggagtgcattagcaagctttatgagagtacttttaccacttccgtttggaccaagaagaccaactattcttcctttattaacttttaaattaatatctttaagagcttccttgttagaaaaagttttagataaatttttacattctagaatagcattattattcattatttcatctcctttactattgattcaacaagttttattgcttcttcttttgtatatcctatctcttccattctttttaaaaagttagatatttgatgttttgctaaatcatttcttatatttttgatcatatcagaatcctccgtaataaatcgtccacttgttctcttactaaatactagccctgttttttcaagctctgttaatgctttttgcatagtatttggattaacagaagcttcactggcaatatcccttactgaaggaagtttatctccaggtttataaacgccacagattatttttaattgaatttgttccataagctgtaagtaaattggtctgtcatcattaaaatcccatgacatagtctcactcctttttatattgtattactgtattattgtactaagctgttaatacaatgatagtacaactggaatcatatgtcaatacagaaataaaataatctttaaaattaattactataatagatctgttaattaataaattaagacaaaaatttttataggatttatttaatttatatttagaatatgtatgaaaatatatattcaatattaaggaataatagtatatcaataaatttaatataaagtttttagaattcaatatatttttatttattgaatgtgtggacatgcagtgatataataattcaaaaggtgtatatacacctgtaaacattaaaaagagtggtgtaaatatgaagttaagtttagaagataaaatattgaaattaaaaaaagaaagaaatgcggttatattggctcattattatcagccaggagaaattcaagctttggctgattatgttggagattcatattatttaagtgaaaaagccagagattgtaaagaggatacaataatgttttgtggtgtaagatttatggcagaaagtgcaaaaattttatcaccacagaaaaaagtacttatgccttgtcctagtgcaggatgtgctatggcagatatggccagtagtaaagctgtggttgagatgaaagaaaaatatccagaggcatttgtagtatgttatataaattctacttataaggtaaaggcacattgtgatgttgcagttacttcatcaagtgcattaaaaatattaaaaaatgttcctaataaacagatattatttttgccagataaaaatttaggtagttatatttctgagttctttccagataaggaatttatattatgggatggtttttgtagatgccataataaagtaagcaaagaagatatttttaaagctaaagaaaaatatagtgaggctaaagtacttgtacaccctgagtgtccaaaagacataagggagatggcagattatattggaagtacaagtggaattattgattatgcgacaaatgatgacggaaaggcatatatagttgcaactgaagagggaattttatatgaactaaaaaataaaaacccagataaagtatttttgataccaggagacaaaatttgttgtcaagatatgaagaagacaacacttgaaaatttatatgagtcacttttaaatatgagtaatgaagttgtattggatgaagaaataagaaaaaaagcattaaaatctttagaaaatatgcataaattaggaagtgaaaaaaatgaataaattttttgatgttgttattattggatcaggagtatctggtctttattcagcattaaacttgagaaaaaatctaaaaatacttgtagtatgtaaagataaattaactatgacaaatacgtttttagctcaaggaggaatatcagtagcaaaaaataaagaagatataccattctttattgaagatacgttaaaagcaggacaatataaaaatgatatcaaagcagttaaggttcttgcagaagaatctgcatataatatagaacaattaatgagttttggcctgaattttgatactgataataatggaaatattgattttacaagagaaggagcacattcagtaaatagaatagtgcatactaaggacaatactggggaaagtgttgcaaaaatattaattgataaaatcaaaaatcaaaaaaatataaccatttatgaagatacttattttgcagatttaatagaaaaaaataatgtgtgctctggcgttatattgattaaggataatgaacaggtaaatgtatatgctaaatctattatactagcatgtggtggaattggaggactgtttagaaattcaactaatcaaagaattttaaaaggtgatggaattgcagcagcagtcaggcataatgttgaattaaaggatattaattatattcaaatacatccaactgctttttatgaagaagataaagatgatagaagattattaatatctgaatctttaagaggtgaaggtggaaagcttacaaacataaatggggaaaggtttattgatgaacttttaccgagagatatagtatctcaggctgtttatgaagaaatgagaaagacagaaactccatatgtaaatcttgatataagatttttaggtaaagaatatattataaatagattttcttcaatttataaatcatgcttagaaagaggaacagatataactaaagaacttataaaagtttctccagctcagcattttttcatgggtgggataaaagtaaatatagacgcagaaacatctatggagaatttatatgcagtaggtgaagcaagctgtacaggaatacatggagctaatagacttgcaagcaattcacttttagaaggtcttgtattttctaagcgtggagcacaattaattaatgaaaaaatagataatatagaaaacaatattgttattgtgaaagatataaatactaatataacagagttaagtcttgaaaatgaacgaattgttagaagaactattgaagaaatgggaggaaaacttgaaaatgaatctcttagctatagataatataataaaaaatgcattacttgaagacattccaaatgaagatatatcaacaaattgtattataggtgaaaaaagtatgtctacagttgatcttatatgcaaggaaaatggtataattgcaggccttgaaatatttaaaagagtatttgaaatacttggtgatgttgagattgatttatataaaaatgatggagataatgtttatataaaagaaaaaataggcatgctaaagggcaacactagaaaaatattaatgggagaaagaattgcattaaatttactacaaagaatgagtggtatagcaacactgaccagtagatttgtagaagaaattaagcatacaaaagcaaagttattggatacaagaaaaacaactccaaatttaagaattctagaaaaatatagtgtgaaaattgggggaggatttaatcatagattcaatctttctgacggagtaatgcttaaggataatcatataagtgcagctggtggaataaaaaatgcagttaaacttgcaaaagaaaattcttcttttgttagaaaaattgaagtagaaacagaaacaattgaaatggttagggaagcattagaagcagatgctgatataataatgcttgataatatggatttagaaactgcacagaaggctgtggagttaattaatggtcaggcacttatagagttttcaggaaatgtatgtttagaaaatataaaaaaaattgcagagattggtgttgattatatatctgtaggagcattgactcattcttgcaaaattttagatcttagtatgaaaaatttacaaatatataaataagtaaagtagaatcaaatgtttaaatgcaaagataggagggatatctttgcattttatatttttttaggaaattataatatgaattcttaattaaaagtgtgatacagccacttatatggatattaatataactaaaacaatatataagtaaaccgataggatatattgacaaaatgtattaaaaataatataaattattataagataaaagattatttttattaataagtcatagaataataaagaagaatgtattatatacataagaagaactcaggaggaaagtataatgagagttataattattggaggaattgcagcaggaacaagtgcagcagcaaaatttagaagactgcataaggatgctgaaattgtaatatatgagaagaataatatagtttcttttggagcttgtggtttgccttattttgttggagacttttttgaagattcaaataatatgatagcaagaactccagaagcatttgttaattcaggaattgatgtaaaaacattacatgaggttaagagagtagattttgagaataaaaaagtaattgtacaagatttaaagggaaatgaaaaatttgaagattattatgataagcttatgatagcaactggtgcttcaagtataactccgccaattaaaaatttagatatagaaaatgttcatacattaaaaagtatggaagatggaattaggttaaaggaactgtttagagatgaaaataataagaacattgctataattggtgcaggttttataggtcttgaagcagtagaagccgctaaaaagtatggtaaaaaggtttctgtatttcagttaggcgatagaatattgcaagatgtttttgataaggagataacagatcttcttgaagaagaattaagaagccacaatgttgatttatatctacaagaaagtgttacagagattataggagataaaaaagtaaagaaggttaagacctctaatagggaagtagaagcagatgttgtaattatagcaacaggagtaagaccaaatactgaattcttaaaaaacagcaatttagaaatgcttccaaatggagctattatagttgataattatggcaaaacatcaattgaggatgtatattcagcaggagattgtgctacaataacacagattataacaggtgaaaaagcatatgtaccactagcaacaggcgcaaataaacttgggcgtattgttggagaaaatttagctggtgcagatattgaatttcaaggatcactatcatcaagctgcataaaagtaatgaatatggaagcaggaagaactggtataacagaaagtaaggcaaaagcattaaatttaaattataaaactgtatttattaatgatatgaatgctacaaattattatcctggtcagagcaaaatatatataaaattaatttatgattcagaaagtaaagttatactaggaggacaggttgcgggatataaggatgctgttcaaagagtgaatgtaatagcagcatgtatatatgggaaacttactacaaaagaacttggaatgcttgatttatgttatgcaccaccatttgcaagaacatgggatgcactaaatgtagcagggaatgtttgtaaataaaaagttaaaaacttaccaaatagcaagtgtttatttggtaagttttttattttatgcattctaaaaagtaaaaatatggtaaaatagaaggtaagaatttaatctgatacttaaaaataaataagaactggaaatgaattttgattttatgaaattaaaaaaattgtatatggggtggagaaaaattaatgaataaaggagtatatgaaaaagtagaatttgaaataccaaagaaatggagattaacttttaataaattattaaaagttaatccatcacaaataaataattatgatgagagcatttggaatgaattttcagaagatattataaatatggttaatcatgaatctaatatcatattagatataggatggtatccacagtttgatagaaatggttattatggtcttgttttgattgaagataataaatggaacaagcctatagaaacacttgttacaagagatacaaaggaactgatagataaaattaatattatattgaataaatattaattttgtttgagcctataaatgttttcagagaacaagtaaaattataaattttatatttggttagttgaagtttgttaggatcgcttttaaggttagtaattgtaacatgtaaattacactaataatataatagatattataacttttttatgtaaacaattaacgcgttgaaaataaagagaaatattaaaaaaaatataaataaaaaaggaaaatgaatataaaatgtagaatattaaatttaaaaatatttataaaattggcattatggtaacataataagggggagtattatatgaataaaagaaaagtactaatacctatagatggaactgaaagaagcatgcactcattagaatttgttaaagagatatttcccaaaggttctgttgatgttattttaatgaatgtaaaagaactggtattgttaaatgaaatgatagtagctaaagaagttgaaatggcaaaagacttatcagaggatatcttatcagaagctaaggaaaaaattcaggattattacaatacagaaacatactttacatttggctatccaggagatgagataattaaaaaagctaatgaagaaaatattggaataatagtaatgacaaaatcaactaaaagaggtttaaatagaattattggttctgtaacttcaagtgttgtaaaacgtgcaaaatgcatagtaatgatcgttccaaatgattttacaatcagtataaaataaatgttactataattttaacggtattataactataaatcatagaatttatttaaataaagtgatataataaacaacaattaaatattcttgtaaaacaggtttttaatttattttatataaatattaaaactaattatttttaataataaggagaagaaaatgagaacagtttatagaaatccaagagaattagcaacatgtttaaaggatattgtggataattactatgaagatttaataacctatgaaaatatggaagcgaaaataatgaaaattgtgaattctaatagggattcaatttataaagaaaaggctatgtcaactaaaatttcaaatgttataggttcgaatagagaacaagtaataaatgaaattgtagatagaaataaatagtttaaataaggctattttatattgaaaataatttaaaatagccttatatgttgacatttaatttttttagaattaatatagtaataaattaaattatgaataaatccaatgaaaaggaagagtagttaagttaaggttcaataaagagaactagggatggtgtaatcctagtaagaaggacttagtgaatgggccttggaggaattaagggaaatctgttagaaattattttaacagaaagtatctgatatggtagctgcaccttacagcagaagcattaatagtattataatctatagatgtgaaatttatattgtaattttgtgctgtattttatgcacattttaggtggtacaacggatatatctccgtcctatttttaggatggagttttttattttagataataatatgtttattaagagataatttaaggagtgaatttataatgagtaagaaaataatattaacaggagatagaccaacaggaaagcttcacataggtcattacataggatcattaaaaaatagggtacagcttcaggaatctggtgaatatgaaagctttataatgattgcagatcagcaagctttaactgataatgcaagagatccagaaaaaataagaagaagccttacagaagttgctttagattatttagcagtaggattagatccagcaagatcaactatttttgttcaatcacaacttccagaacttcatgaattaacaatgcattatttaaatcttgttacattatcaagacttgaaagaaatcctacagttaaatctgaaattaaacaaaaaaattatgaaaatagtattccagcagggtttttaatatatccagtaagccaggctgctgatataacagcatttaaagctacaactgttccagttggtgaagatcagcttccaatgatagaacaaacaagagaaatagttagaagttttaacagtctatatggagaagttttagttgaacctgaagcagttatacctaaaaatgatacatgtggtagattaccaggaactgatggaaaagctaagatgagtaaatcaataggaaactgtatatacttatctgatgatgcagacacagttaaaaagaaagtaatgtctatgtatacagatcctaatcacataagagttgaagatccaggtcaaatagaaggaaatacagtatttacttatttagatgtatttgctcctaacaaagaagaagtagaagaaatgaaggctcactataaaagaggtggacttggagatatgaaagttaaaaaatatctaaatgaagtaatgcaggctgaacttgaaccaataagaaagagaagagaagagtttgctaaggatatggattatgtatataagatgcttaaagatggtagtgataaagcgagacaagtagctgcacaaacattaacagaagtacgtgaagctattggtttagaatattttaaataaagattagagttttccgaagtattaaagtgatttaatacttcggatttttattttaaattaattataaaaattaaaaatatattacaagtctgtgaagtttatatgttatatatgtaaaattcacagacttgtttcatatattgaatatctaattaatatagataaacatgatgaaatttatgtaattcaaaaaatagattttaaatagagacaataagagcagagctataaaggagtggggattatggatgagtttgaaaataatgaatttgaagataaagaaatgacaatagaaaaatgtctggaggctataaatgaaacacaaaataaaattgcagaagaagaatcaatgaaacgcattataagagaaacattgaaagaaataaatgaaaaggaaattttagaaaaagacaaaaattttaagaatgttatagaaaataaatttaaaagaatagaagttttattaagtaaaaagaaagtcaaaaacatcattatgcgtataatgatgtttttggtgatgacgatatttacatttaatgggccttaaataaagcctatgcaaatgattatgaacttaacaatattgcaaatactaacttaaataatgaaacatcaagggatgatataggggcagaagcagcatctgaaaataataatagtaatcagaatgaaataaaaagttctaaaggagtaaacaaagaggggaagaatattcttatgatgcagtaaaaataaatgataaattaaaaaaaggagattatagtaatggtggggaaaagattgtatttctaacttttgatgatggaacatccacaacagtaactcctaaggtattaaagattttagatcaatataatattaaagctactttctttttaatggggaaaaatatagataacggaggagaagctgcaaaagaacttgttaaagaagagtataattctggacatgctataggaaaccattcatattcacacgattataatattctttatccaggaagaaccttaaatttagaatctttcaaggaagatttcaataaaaatacaaaactattaaaatcaattctgggagatgatttttctacacgagttataagatgtccaggagggtatatgtcatggaagggaatgaaccagcttgatggatatttgaatgataataatatgacttatattgactggaatgcattgagtaaagatgctgaaggaaaaaagaaaaatgctgatgaactatttcagaatgcagtagatacatctaaaaacaaggaaattgtagtattgttaatgcatgatacttatggaaaggaagagactgctaaatcacttcctaaaattattgagtactttaaaaatagtggatatgaatttaaaacattagcataataagattttattttaaatagaaactgcactttatttatgaagtgtggttttttatagaatcattgtaagaataataaaattaaaaatacaaaacctattataaagataaattatctaaataatatggggagtgtacattatgaagagaatatggaatatttataaaactgatattaaaaatatagtgacaaattatgctgcgtttataactgtagcagcattatgcatacttccatcattatatgcatggtttaatatagcagcttcatgggatccatatgcaaaagaagcaactagtcagataaagataggtgtaataaataatgatgatggaacagaggtagaaggaaaagaaataaatatggggacttaatagtccatggattaaaagaaaatgaacttatgggatggcagtttgtagatgacgatgaggctgagcaaatgcttgaacaagggaaattttatgcgaccataacaataccaccacaattttctaaggatattacttcaattattacaagtaatataaaaaaaggagatataatttataaggttaatgaaaaaataaatgcaattgcaccaaagctcacagataaaggtgctagcggagttcaagaaaatataagtaaaacattaattgaaactgtaagcagtactcttttgaatgcaacaaagagtattggaatagaattagaaaatataaaacctaaaattactaatgtatataatttattaaaagaagttcaaggagaatttgatgatattaatagtactgttgatttagcttataagggagctattcaattaaaagatttaacgcaaaagataaatgaagatattccattaataaaaaccacaatagataacagtaaagatcttagtaatgaaataaaaagttttttaacaaactcaaaagcaagtcttaatgatttaaatcctacaataaaggaagatataagactcctaagcgaaatatctggtggaatatcagattatgcttcagccattagtgatgctataaattcaggaagtgataaagtgcctggaatgatagaaaatcttgagggaaaattaaatagtattggaaatttaacaaattcacttttaaaggtaatagaaaaattaaataagataagtcctaaacttgactctactgtagagaaattaagaaatataaatgcatcaatagaaagtactaaggagaatttaataaaagttaaaaatgcagtaaattcaggaacgactccagatttatcagtattaaataatataaaaagtctttcagaaagtgtaaaagcagtggcagatgatttatattcaaagtatgacagtgatattgctgttaaaataaatagtattatagatactgcatattcaaccagtgataatataattagtatattagacgaatcagaaaaaaaattacctaatgtaagtgagttgttaaatactgcatatgaaggtgcagataaggggatttcgggaataaaatttataaaagaagaattgcctcaagctgaggaaatgataaatagtttagttgggaaaatggataaagctaataatgatgaagggttgaaagaattattagaattattaagaaatgatgttgaagaaagaagtgattttttagctaatccagttaacttagttgaagaagaattatttccaatgggaaattacgggacagcaatgactccattttatacaacattagccttgtgggcaggatgtttgtttttagtttcattattatctgtaaatccacataatacagataatttaggaaataaatttcttaatgttaataggagcgaccaaccaaaacagcataagaaaataaaaaaagaagcgttgggatatgcatttaagattacagaagagtattttggtaaattattactatttgttacactggcaataattcaaggttttgtagtttctataggtgatctttacatactagatatatattgtattaatccaggtatttttatttttgtatctataattactggaataacattttcattaattatttatactgcatgttcagtatttggaaatgttgggaaagttatatgtatagtattacttgtatttcagattggtggatcaagtggaacatttccaatagaacttacaccaaagtttttccaaagtattcatccgtttttaccatttacatatacaatatctttaatgagagaaatgattggtggtatggttaaagaagtagttataaaagattgtgctataatactaatttttattggaatttcacttttgattggaatattcttaaaaacaccatttaacaagtttataaagaaatttaatgaaaaatttgaagaaagtcatttaggtgaataaattagttattagaatataatttataatagatcatataaaaattcagcagtttgatttttaaaactgctgaatttttataagattagaatgtttagcaatattataaaaataattaaacatatgagaattattaaagaaacatggaaatttaaagttataatttccccagattgtaataggttttttagtaaaataaaaagtcacaaaaaagagttctcttgtatttaattttgtgaaaaatggaattaaccttatatctgtaattttataatagacatcatcatgattcatatctataatttgttgtaataatgctttatgttctttgtcaattaaattgagaagattatctttttcagatttatctattttatttatatagaaatcaacataacattcgttattattttgtttaaaaacatcacatataaaattgattaatgagagttcactattttctacaagatttccatctaaggtgaaatttttaaattcattaaatccatctaaaatattattgaattgtatacttacattgtttttaaattctaaatttgaaacagggataggcaaactattcatgaaagaatcactccttgtaatttcaattataaattgcaatatacatatactataaattatattgattataagttaaagaaaatatttaaggttatgaaaatttaaataacttatagcatttatgaacataataagattaagagattttgttttgtaagaaaaaataaaatacatatgaacataggaggtaaacaaatgaagagtaaaattataaagatgtcttctttaatatgtgtaattatttcctttttatctattaatggttgcaagtcaaattctgcaacaaatatagaaaaggaaaatacaaatgtaaaagatgaaagtagtgctaagactgatgaaagtaaaaataatataattctgcttgagaatgaaaaaatagcttctgtattatctgaaaaagaacgaaaaccagaattggaaaaagcacttaaagaaaaatatgatttagatgacaaaggagctaaggagactagatattattataattgtattgatcttaatggagatggagtaaatgaaatatttgtagaagttgtaggtccaatcactagtggaactggtggagacagtgcagtgatatataaagataataatggaacattagaagaaataagtgattttacacttataagaaatccaataattataagtgacgagaagagcaatggatggaatgatattatagttgaatattctggtggaggtgcacctaaaaagtatgctattttaaagtatgatggtaatgagtattcaaaagttaatgaaagtgaaacaattgacagtataaaagatgttagtggtgttgctattatatcaaattatatggaaaaagatatgaaagctagtgaaggattatatttaggataaaataataatacatattaataaaagcattctatatgaatatttttatatacttatttttatggtagagagtattaaataataaaactgctattatataaggattatattatattcaaaggaatgcttttatttttattattagatgataacataagtatatatttacaaaaattgctttttattaataatgaaagatgagagtgaacaaatgtctagaattatgattattgaagataatgaaaatttaaaaaaagaactcattgaatttttatcacgatatggatatgattcatatggtgtagaggattataaaaatgtagttaatataatattaaatgataaaccggatttagttttacttgatataaatcttccatattatgatgggtattttatatgtcgtgaaataagaaaaaacaataatattcccattataatcgtaacaagtagggatagtgatatggatgagattatgagtattaatttaggtgctgatgattttattacgaaaccatataatactcaagtacttttagctagaataggatcattattgaggagaacagctgttgaaaatgttcaggacatattagaacataaaggccttaaacttaatataaacaaaggagaagtatcttataaagatagaagcattgatttaagtaaaaatgaattcaaaatattatcatgtttaattaaaaataaagaaacaatagtaagtagggaagatttaatggattatttatggaattcagatctttttattgatgataatactttgtctgttaatgttacaagacttagaaagaaattagatgatttagggtttaaaaatggaatagaaactaagagaggacttggttatatattactatgaattttgggaattatatattatcgaaaataccatatattataatgaattttatcatatatctcttaggtgcggttgttttgaaaatagcagatattcctaatgtgattttgttttttatatttttatatggtttataccattaatcgtatatattgggcttcaatttgtacaagagaaaaggttttatggtgaaatgactgaattaagcggtaatttggataagaaatatttattatctgaaataataaaaaagcctaattactatgaaggaagaatattttatgaagtattaaaggatgcaaatagaaacatgcatgaagaagtcaactattataagcatcttcaaagtgattatcgtgaatatatagaaacatgggtacatgaaataaaaactcctatagcatcttcaaaaatgattctagaaaatagcatatcaaatgataagaatgctcttgtagatgaaatgaataaaattgatagatacataacacaagctttgtattattcccgaagtactgattttaataaggactatattattaaaacttttaatttacaaagtattattaacgagtgtataagagaaaatagacgagaatttattaataaaaaaataaggttaataatagatgataatactgatgttcaagttacaagtgatgctaaatggcttaaatttataattaatcagataataattaattctataaaatatagtagaaacgaatgtgcacaaataaaaatctatatagatgaagattataataatactcatataaagaatgattttaaaaaggaatttaatgatatgattgatgcaaataaaaaagtgaaactagttatagaagataatggaataggaattcctaaaagcgatattaacagagtctttgataaaggttttacaggagagaatggaaggatttatggaaaatcaacaggaattggcctttatttatgcagaaagctttgtgaaaagcttaatcttaatatagaacttttttctgaaccagaagtttttactaaagtatttatagagattttaaagtgattgaaataatattatgtgaatgaaaaagcggcgttgccgctttttttaatagacttcaaacatatataattagccaagaaataaaataatcttacaaaattgtaaggtacgtgaaagagtaatcaatatgagaagaatagctaaggtcttataataaaatcatacattaagacgtggaggaatttgaaatggaaagtatattaaaggttgaaaatattgaaaaatattatggaaataaagataacattactaaagcaattgataatataagctttagagttgaaaaaggtgaattcgttgggataatgggtccatctggaagcggaaagacaacattattaaattgcatttctactatagacaatgtgactacaggttctattgcaattgatggagatgatattacaagattaaaaggaagaaaattagaaacatttaggagagataaattaggatttatatttcaggattttaatcttcttgatactatgacagcttttgaaaatatagctttagctcttactattgcagggaaaaaaggtaaggaagttgaatctcttgtaaaaaaggcagcagaaagccttggaatagaagaggtattatcaaaatatccatatcagatgtcaggaggacagaagcagagagttgcagcagcaagggcgattgtaaataatcctaaaatcatattggcagatgaaccaactggagcattagattctaaatcggcaaagatgcttttaaattcaatagaaaaattaaataaagaattagaagcaacaattttaatggtaactcatgatgcatttacagccagttatgcacatagaattcttttcataaaggatggtaagatttttaatgaacttgtaagaggagaagatactagaaaagatttctttaataaaattatagatgttgtaacaatactaggaggtgattctaaagatgtattctaaaatggcatttaataatgttaagaagagttttaaggattacacagtttattttttaacattaactttcgcagtatgtatcttttatagttttaattcaattaattctcaaagcatattgagtgaattaaatgaaggtcaggcacaatatatagatatgcttaatcaaatgatgtcaattttatcagttggagtatcagtaatacttggagcacttattatatatgctacaaattttcttataaaaagaagaaaaaaggaatttggactttatatgattcttggaatgaaaaagagatcaatgtcaacaatattgtttttagaaacattttatattggagtaatatctcttttagcaggtttgattttaggattaattttagcacagattctttctatattcacagcaaaattatttgttcttgaaatgacaaaatatagcttttctatttcatatcaagctattgttaagactgctatatattttgcaataatgtatttaattgttatggtttttaatgttatatgtgtatcgagatataaacttatagaacttttaagtgctggaagaaaaaatgaaaagatgaaagttaaaaatatatatatttcatcttttatatttatcacatcaattataatcttgggattttcatatcattatattggaatatcaagtttggattacactaaaatagaatttaaatattctataatacttggaatagtaggaacattattattcttctatggtatttcttctgtattgttttatatggtttctaaaaaaagtagcatttattataataagttaaacagctttagcataagacagatttcaagtaaatttaatacaaattttatttctatgacagttatatgtttgatgcttcttgttacaataggttcacttgcatgtgggcttgcggtaaaagattctatggaatcaacattaaaaaaatctacacaatttgatgcatcaatttcatattacagcattgatgaagatactgttgataaaaatccaatagaggctatggagtcattaggttatgatattaatgataaatgtgacagtatgatagtaagaacatattattcagaaaatgcaaatgcaaaagatcttctttcaaagtatgccgttgatgaagataagacaatacaagagatgataaatggccgtatgtttgaaaagtcaattaatatgataccagtttctgtatttaatcaagtgagaaagatgcaaggaaatgaacctataggactttcagataatgagattcttgttgcaagtaattatgatgcagtaaaggttataatgaataagtttgttgataatgtagatggtgtaaatatttatggaaaagaatataagcttaaagaaagaaaagtatttgatgattgcttatatacaactccaacagcaagtgtactttttgctttagttgttccggataaggtaatagaaaataatgacgttcatttatatgaacaggttataaatattaattttaaaggaaatgacgaagagaaaaaattagaagaagaaaagcttactaaaatattaaataaggaatcttttatggataacaatgaacataaaaaattagatggggaaagaggattttggatagatggaatgacaagacagatgtgtatggatgcaagcagaggtttatcaacacttgtattatttgtaaccatatatcttggaattgtatttcttctttcaagtgcagcagtacttgcacttcagcagctttcatcatgtaatgaatcaattgatagatatagttcattaagaaagattggagcttcaaaatctatgataaatagaagtatatttactcaagtagctatattttttatgtttccactaggtcttgcaataatccattcaatagttggaataagagcagtaaacagctatcttatggctttaggttcttcaaataaattaagttcaatttttgtaacagcactaataataataattgtttatggtggatatttgtatggaacatatatttcatataaaaatgttatagataatgaatttaattgatattaattagtattttaaattataaattcacttaatactatagatataataaaaacacttatgaataatatgccatggcccatttggatagaagacttagcagaaaacatagtatatttaaatgataagtatgaaagtacatttggagtacgacttgaatcggtattaggaaaaagcaatataagtatttttaataaagaattaataaaagtatataatgaaaaaattaagagtaagatgagcgaaggaaatgtatgtatagtgaaagaaaacattaatgggaataatatgatgttctatataattcctattaaagataaagaaaattatatacaagcatttggaatgataattattgatataggaaaaatagatgaaaatgaaattaatataaagaagcagagcacaatattaagaacaattatagattctttaccagaatcagtattctataaagataaagaaagtcgctttattggaattaataagaaatttaaggagttttataataataatggcatttacgatattattggaaaaagtgatttggaaatatatcctgacaataaaatagcagctgaatttgtgaaaattgacaaagagataatggaaactagggaaacaaaatattatgagcaaacagtaaaagataaatttaataatgaaataatagaggaaaatgtcaagatacctgttattagtgatgatggagaagtttggggaattgtcggattatcaagagatataaccgaaagaaaacagattgaaaaaaagctcagatatttaagtgaaaatgatatgttaactggtttatataataggtatagctttgaagaaaaaatacaagaacttaatgaaagtgagaatcttccactaggaataataatgggtgatgtaaatggacttaaacttgtaaatgatacattagggcacctggaaggtgataaattgctgataagtgttgctaatgtattaagagagatatgtagtgagtttacaaaatacattttcagatggggaggagatgaatttattattttacttcctaatgctggagaagtacaatgtgaagagattattaataaaattaataataaatgtgaagaggtagagcacgaatttattcagttaaatatagctttaggtgaggctattaaagttactttagaagaagatatatacagttgtataaagaaagtagaggagaaagtatataggacaaagcttcttgaaaagaaaagtataaaaagttctataataaattcattgaaaaaaagtttacaggagaagagttttgaaactaatgagcatactgagagagtttctaaatatgcaaaagcaattggaaagaagatgaatttgaaaaaagatgagctagatgagttaatgctaacagcccagcttcatgatataggtaaaataggcatagatgaacaaatcctcatgaaaccaggtaaactcacaatagatgaatttgagataatgaaaacgcatgctgaaaaaggatataggataataaatgcatcaagtgatttagatacaattgctaaatatgtacttggtcatcatgagaaatgggatggaagtggatatccacttggattaaagggtgtagaaattccacttatatcaagaataatcaatgtagtggattcatatgatgtaatgacaaataacagaccatataaaaaagctatggcacagaatgaagcattacatgaacttgaaagatgttcaggaagtcaatttgatccaaagatagtaaacatatttaaagaatatatgaaatgtgatttttttagggtataattatatcagtttgacaattaattgccatagatataaaatatattttagaatttaagtgattagaggagtggttataatatgataaaagaaaatggtaatatttcaattgacacagaaaatatatttccgattattaaaaaatggctatactctgataaggatatctttataagagaagttataagtaatgggtgtgacgctataagcaagcttcaaagacttgcaagtataggagaagctaaagttcaagaaaatgagcaatataaagtaatagtttctataaacaaagaaaagaaaacacttaaattcagtgataacggtattggtatgactgaagatgaagttaaaaaatacataaatcaggttgcattttcaggtgctacagattttatggaaaaatataaagacaaaatggatgatggaaaagatataataggacactttggattaggattttactcaacatttatggtgtctacaaaagtagagatagatactttatcatttaaagaaggtgcagaacctgttaaatggatatgtcatggtggtactgaatatgagataacatcttcagaagaaagaactgaaagaggtactacaattacattatatcttgatgatgaaagtacagaatttttagaggaatataaggtaagacaaataatagaaaaatattgctcattcttacctacagaaatatatttagaagatgaaaataaacctaaagaagaacctaaatatgaaacaagaaaaaatgatgatggaacagaatatcaagaattagtagaaccagaagcaccaaaagctttaaatgatatacatccattatggatgaagaaaccaagtgagtgtactgatgaagaatataaagaattttatagaaaagtattcatggattttaatgaaccattattttggattcatttaaatgttgattatccattcaatttaaagggaatcctatatttccctaaattgactcatgaggttgagataagagaaggacaagtaaaactttataataatcaagtatttgttgctgacaatattaaggaagttattccagaatttcttcttttattaaaaggaactattgattgtcctgatttaccattaaatgtttcaagaagtttccttcaaaatgatagagatgtggctaaaatctcaaatcatataataaagaaagttgcagataaacttgttgatttatttaaaaataatagggaggaatttaataagttctggcctgatattcaaatattcattaaatatggatgtttaagagatgaaaaattctatgataaaattaaagatataataatatttaagaatttaaaaaatgaatttgttacattaaaagattatcttgaaacaaataaagaaaagcatgaaaataaagtatattattctaatgatgaaaagcaacagtcacaatatataaagatgtttaaagagtatgatcttgatgcgttaatcttagattgtacattagatgatcattttataacattcttagaaatgcatgaaaatggagtcaagtttaaaagaattgattcagatatatctgatacattaggaagtaagacagatgaaaatgatgaagttcaaaagaacattaataaagaaattgaagatgtatttaagaatacattaggagataaagtaagtaaaatttcagttgagggattgaaaaatgaaaaaacttcagctatgattttaatttcagaagagtcaagaagaatggctgaaatgagtaaaatgtatgctcaagctggaatgggtgcgatgggaatgtttaaggaagaggaaacattagtagttaacaataacaatccacttgtaaagaaacttgctgaagcatcaaaagatgattctaaaaaggatgatgttaaatttatatgtgaacatatattagatttagctaaaatagcaaataaagaattagatgctgatgaaatggacgaatttattaagagaaataacgaacttttaaatagagttatctgtctttaaagataatctaatagaaatataggctataaagctgccataaaatgagggggaaaatcattttgtggtagcttttttatgtaaaagaatatactagaaaaaattaaaaatataagtgaaaagtttttaaatatagtaataatagaaatagaaagattatataatttaaagagttcaaattgctataattagacagtgattattaaccattgagaatttgtcctaagagtggtataattattggagaaaaattgaatggagggctttataaatgaagcacataaaaacaataaacaacccaaacataaagaacagtttatgcaaaccaggctgtaaagaatgcgcaaactcttgccaatcagcttgtaagacttcttgcacagttgcaaacttagaatgcgaaaactaatttttaagagcagtaactgaatagttactgctctgctttattcagcattataattaacaaattaataatcgctttggtgatttttacatatatatgcattaatattttaggaggaatttaaaatggcattaatacataagtttaaacaggatgagaattattttgtattggatgtaaatacaggagctgttcatgttgttgatgagctggtttatgatatattagatgataataagtttgaacctaaaaaggatattttagaaagacttgaaggaaagtatgatcatgaagaactttctgaggcctatgatgaaattcaagaattggctgaagatggtattctttattcagaagatcaatacgaagagatagcgcatagttctatggatgacagggattatataaaggctatttgtttaaatgtaatacatggatgtaacttaagatgtaaatattgttttgcagatgaaggtgaatatcatgggcatggtggcgttatgagcgttgaaacagctaaaaaggcaatagactatgtaataaaaagaagtggtccaagaaaaaacatagaaattgacttatttggtggagaacctactttaataatggacaagattaaagaaattataaagtatgcaagagataatgaagaaaagtggggtaagagaataagatttacaatgactactaatgcaacacttttaactcctgaaatgatggactatatggataaagaaatgggcaatataattttatcattagatggaagaaaagaagttaatgataatgtaagaataaagccagataagagtggatcttatgatgatataatacctaatattaaagaaatgataaagagaagaacaccaggaaaaacttattatgtaagaggaacatttacgagagataatactgatttttatgaagatgttatggcaatggtaaatgaaggatttagagaattatctatagagccagtagttttagaagataatcatcctctttcacttagagaagaagatcttccaaaaatatttgaaaattatgataatctttactatgaaatgaagagaagaaaaaaagatggagatgaatttaaattctatcactttaatatagatcttcaaggtggtccttgtgtttataagagaatttcaggctgtggagcaggatttgaatacgttgcaataacacctcaaggtgaagtttatccttgtcatcaatttgttggtaaagaagaatacaaattaggtgatatatatgaagatacatttaattctgatttagctaaaacatttaaaaaggcccacatttacaataaaccaaaatgtaaggattgttgggcaagattttattgtagtggtggatgccaagctaacaatgttaattttaatggagatatgaatattccatatgaaattggatgtaagatgcaaaagaagagaattgaatgtgcaatagcattgaaggctgttgataatgaatagtatataaaaaaatatatagtagtgtgaagttttcacattactatattttttattattaattgtaaaaagatatagtaaaatgttaaaacaagataaaatcatgtctaaaaatggtaaagagatgatataattaagaaacaataaacataaaaaggtgggcaatatgagtaaaagaaaagaaagaaataatggcagtataaaaaggaatttaatatgtatatttattgttgctattatagttattttttcaataactacagttttaattgggtatatattgaaaaaaagtataactgacgtattacttaataaatcaatagaaacagcagatgaagttaagggatcgatagaacttattttagataatgatgattctaatgaaatagaaaaacttcagaatcttgttgaagaaaagtcaaaaaaggataatattgcatatgcagttataatcgatgaaaatattaaagcaatagctcatagtgataaagaaaagataggaaaagtttatgatgatgattacactatagatggagttaagaatcaaaaaatacagacatcaaaattttatgcagatgttcagaagtattggacttatgatataatgattccattggaaaagaacggaactaaatatggtgccttagatattggaataccgattagtggtattgatagtattattaatagcttttttaagacacagtttatattaattataatagcgattattattatatcgataatagtaattggttcattaaataaagcttttagaagtatgaagtacataatgaatgctatagataggataagtgagtttaatcttgaaaaagatagtgaattagaatctttatgtgaaaaaaacaatgagtttggtctcataagtaaatcattactttgtatgagtgaaaagattagaaagcttgtgattacaataaaaagtagtgcagataaagtagatgaagtttcacttgagttatcaagtataactaatgaaacagtaaagtctattgaatgtatggaggattctgttttagagatttcaaagtctgcaaaaagtcagtctgatgatatacaaaatgaagtgacagaaataaatgatttaagttatcaaatagataatgcaattgaaaaaactaatctggcatttgataagattaaaaatacttcggatttaagtaaagaaggaataagtatagtaaaaaatttatcaagttgctcagagaaaaataaatctatatctgaagaaatacaaagtatagtatatgatgttgattttaaggcaaaagaaataagttcaattgttgatattataaatgatattgctgaacaaactaatcttttagcattaaatgcttctattgaagcagcaagagcaggagaaaatggaaagggatttgttgttgttgctgaggaagttaaaaagttgtctgaagaaacaagtagatttacaaatgaaataagagatagaattaatcttgttcaagaaaaatctggacatgcagtggagtgcgtaaatgaaaatatagcaatagtagatgaaaatacaaatgcagtgtcagacacgaataagatatttaataagttatcggaagaactaattataattaatgataatatgtctaatataattaattataatcaaaatatgaattttaagaaagattctattctgggcataagccagaatatatcagcatcatctgaagaaacaagtacagcaacagatgaaattcatacaatagcagtaacacaggcagaagaaataaagaaattatatggtaaagttgaggatttacagtcttattctcaattgttaaataaagaagttggtgaatttaagatttaatatattatataataggctctctaaaaaataatttgttttttagagagcctaaattattttgtataacaagaattatataattgtaaattatacttagttgcaatattagaagaattagataataatttattcatacagtaatataagatgtgaatagataaagacaaggagaaaaaagatgaaagatataattttagataataatttaaaacttatatataagcatagtgaaagtgaacttacatcaatttgtatatcattaaatgcaggagcaggaattgaagtagaaaaaatgggggtggcacatgctgttgagcacatggtttataaaggaactaaaactaaaagtgaatcacagataaatgaacaattaagtagtatttttggatttcagaatgctatgaccaattatccttatgttatttattatggtacattattaaatgaagatctcattagtggaatagaactgttttctgatataattttaaatcctgaatttgatgaaaagggatttaaagaagagatggaagttataaaagaagaacttgatgaatgggatgaagaaatagaacagttttgtgaagataagctgttttacaatatttttaataagagaaggataaaaaatccaataatagggacaaaggagagccttgataatcttacggttacggatttaaagaggttctatgaagaaaattatttcccggaaaatacgtctatttcaattataacatctattgattttaatactgtcaaggaaattatcgacaaatactttggtatgtggaaatcaaaatccattaggagaaattcttatataaataatatagaatatgaaaaaatagatgctagtaaaatccaaattgaaaaaagacaaggtattaaaaatgcaaaagttcagatggtttttccgttagataaacttaattttaaagaattaaatgctttcaggctgttcaatcagtattttggggaaggggttaattctacattgtttgatactttgaggactaagaatggtttggtttacgatgttataacaaggatttctagtgaaaattatttgaaaatgtataaaataacttttacaacatcaaaagaaaatgtaaataaagcagtagaacttgttatgaatctaataaaagaaataaattttaaggttgaacttgaaataaaattagattcattaataaaaagttataagttaaagaggttgtttagagaagaacagagtattattttagcgaaagaacttgcaacatacgatactatgtttggagactataatatatatgagaatgaacttagaaaaatagaaggaattactgaagcagatatattaaattctgctaaaaaagtattaaagaattcagctgtacaggttgtatgctagaagggatgataagtttgaaagcaccattattagaagaattgtttaagtatcacaatgaaaaaaatttaatgctatcaatgccaggcaataaggcaggacttggttttgaaattgatgatttgggtagagaatttatggaaagaatgggaaaattagatattacagaagttgatcccttagataatttacattgcccagaaggcgtaattaaagaatcacagagattattagcaaaaacatataagtctaaaaaggcttactttttagttaatgggagttcgggtggaaatttaagtgctatttttgcttgctttaatgagggagataaagtaataatagagagaaattgtcacaagtctatttataatggagcaattttaagaaaacttaaagtttcatatattgagcctattattgattctgaacatggaatttttctgcctccggataaagataatatttataaagcttttgataaatgtactaatcctaagggaataattttaacttatcctaactactttggtataacatatgatattgaagaaatagtaaaagactttaggggaagaggaattaaagttatattagattgtgcacatggagctcattttggcattagtgaaaaattaccaaagagtatgacacaaattggcgattatgttgtgcttagtgcacataaaactcttcctgcattaactcaaggatcttatattgttgttaatgatgaaaagtctgattttgaattttatttgagaacttttatgacaacatctccatcatatcttattatggcttctttggattatgcgcgatattatattgatacatatggagagaaagattatgaaaaactcattaatatggcagagcagtggaaagaaaaaataaataaattaggaaaaattaaaataatatcgtgtgatgatattaaagcttatggaaaatatgatttagataaaagcagatacttaatgattcttcctaaaggatataatgggcataaacttttagattattttagaataaaaaaagttcaaagtgaaatgagttttgcacaaggcattgtattgattttatctccatttaatactgaagatgattttaaaaagatatatgatataatattgaatttagatctaaaggattttaaatcagaatcattatctgtatatgacaatagtattcctaaaaagattttagaaccatatgaagcgtttaatttatcatatgaaatgatagatattaataagtgtgagggtagaatatcaaaagagtttataacaccatatccacctggaatacctcttgtgtgtcctggtgaaagaatagaaaaagaagctgtgaacattattgaggattatataaaaaatgaaaaagatattttgggtgtagataaagaacagaaaaaaataagcgcaataattgaataatcattatattttaaatatatgaaactgcatatcattagatttgcagtttctttattatgcatgtaattatatgtgtaaaaactagggataactttttaaatgagcggaaatgctcagtttgaggaacagattttttctataaactattatatttatgattgatatatttatcaataaaagctatatattttataataaataataaaaaaatgaagaaaaagtataaaattcaacaataaaagcttgtaaaaattaataaattataatattatatatttattattaaaacatcagaaggttaggcataaagaaaatgatagggggaacgtatgatggaagaaaaaagagaacagtgggggtccaagctaggatttatattagcagcagttggatcagctgtaggtttaggtaatatttggagatttccgtatgtggcatatacaaatggagggggagcgtttttaataccatatttctttgctatttttacagcaggaatacctttgttaattttagaatatggtatgggacataaatttaagggatcaacaccattggcaatagcaagagcaaataaaaaatgggaatggcttggatggtggccaactattagtgcatttattatattatcgtattattcaatgattttaagttgggcagcaaattatttaggatttagttttaagaaaagttggggagcagattcaaatggatttttccataatagttttttaaaacttactgattcaccatttgattttggtggaatggtttggcctattcttattggaataagtttagtttggattataaattggttcatttgttataaaggaataaaaggtggaattgaaaaggctaataagatattattaccaatgcttatattaataatgattataattgcaataagatcagttacgcttgaaggtgcagtaacaggattaaatacattatttacaccagattggtcaatggttatgcagccaaaagtatgggtagcagcttatggacaagtattcttctcattaagtcttgcaatggggattatgatgacatattcaagttatcttccaaaaaagacagatataaataacagtgcatttatgactgcttttgcaaactgtggatttgaatttttatcagcaattgctgtatttggaatattaggttttatggcaacagctcaaggcgtaccaatgtcagaagttgtttcaagtggtgtaggattagcgtttgtagtatttcccgcagtatttagtgaaatgggagctgtaggtacggttttaggagttttattcttcctttgtctattatttgcaggtgtaacttcatcagtatcattaacagaggcagtttcagcaccatttagagataaatttggatggaagagagaaagagttgtaacaggtatatgtatcataggatttttagttagtactttatatgcaacaggtgcagggttatatcttcttgatataattgataacttcataaataactatggaatagtagtagtaggattattagaagttatattaattggttggataataaaacctaaaacaataagagaacatactaatgaaatatcttattttaaaattggaagttggtgggatattgtaattaaattcttaacacctgcaattttaatatatatgttaatacaaagttttatcggagaagttaaagcaccttatggaggatattctttaccagctttattcttatatggatggtcagttattgggattggagttataggagctttactaattactaaaagaccttggaaagagaaaaagatagaagaataaaaaccataattaaagaaagcgtggtgatataaatgagtacagtatctttgatgctatttggtgttggtgcaactgttttatggggaggtcttgcacttacattaggtataacaatttataatgaaagaaaagaggcataacacggttaatttcttaataaatattgagtaagaatagcgtattaaattgcattagagttttgaaaattatataataaattaagattaagtatataaattagagttaattctacttttatatactttttctttattctgtttaatataattttaatatgataaaatatacaaaagatttataatatcttatatgaaggaatttaggaaggtgatgctttaaatatggaaactggagtcgtgactaagcagaaagataaagttaagataaaaaaacctaaaaactataaggttataatgcataatgatgattatacaactatggaatttgtaataaagatattagttaatattttcaataaaagttttatagatgctgaaaaaataatgcttgatgtacataaaaagggaagaggagtagcaggcatatatagttatgatatagcgataacaaaagtagccactgctatgtcaatggcaaaaagtgaaggatttccttttaaattaacaaccgaggaggtttaaatattatgaagattacaagtgatctaaacgatgtgatgctgagggcttatgaagaagctaaaaatagaaagagtgaatatattacgcctgaacatcttttatatgctgcaacttttgatggtaaagttgcagaggcaataaaacaatgtggtggtgatttaaatagtcttcagtataatttgaagacatatataaagacatatataagtattggaagtggagaaccacaagaaagtattgaatttcaaaaagtgataattacagcagatgaacaagttaaatatagtggaaaagaagtaatagatgttaatcatatattagctgcaatctttacacttgaagatagttatgcgttgtattatcttttacaagagggcgtaacaaagagagatttgttatttaatctatgtcatgatgaagatgatgaggtttatattaacgaaaatgaagatccatcaatgtcagaaatagaaacttctgaagatgatgaagaaaaagtgaaagttaggaaagaagatgcatttctaagcaaatatactgtcgaccttataaaaaaggtacaggaagaaaatattgatcctttaatagggcgtaaggatatattagatagaacagttcagatattatgcagaagaagtaagaataatccagttcatgttggtgaatctggagttggtaagactgcaattacaatgggtcttgcaaaacttatcagtgatggaaatgttcctgagaagattaaaggaagtttaatgtattcattagacttaggctctgtgattgcaggaacaaaatatagaggggattttgaggaaagaataaagagaatactagaacttataagcaagaaagataaggctattgtatatatagatgaaatacacagtatcgtaggggctggtgcattaaatggtggtgcattagatgcttctaatttattaaaaccatatctaacagaaggaagtataagatttataggcgctactacctttgatgaatataagaagtactttgaaaaagacaaagctttaataagaagatttcaaactattgatgtaagagaaccatcaattgatgattcggtaagtatattaaatggtcttaaagaaagttatgaaaaatatcataatgtatcatatacagatgatgctataagaaatgcggttattttaagtgataaatatataaatgataaatatcttccagacaaggccatagatataattgatgaggctggagcatatgtcagaatgcataacagtaatatggatgaaaaaattgtagtaagtgaaaatgttattgaggaaataatatcaaaagtatgcagtattccaaaacaaacggttgaaacaaatgaaattaattcacttaaatatatagaaaaagaattgaaagaaaatatatttcatcaagataaggctatagaggaagttgttagatgcataaaaatgtcaagagcaggacttaatgaagaagataaacctgttgcatcaatgctgtttgtaggacctacaggagttggaaaaactgaaatagcaagatgtctttctaaaaagttagggttagatcttgttagatttgatatgagtgagtatggtgaaaaacattcagctgcgaaactcatcggatctcctccaggatatgtaggatatgaagagggaggacttcttactgactcaataagaaagaaaccacattgtattttattattagatgaaattgaaaaagctcatgaagatatattaagtgttttacttcaagttatggactatgcaactcttactgataataaaggaagaaaagcagattttcgaaatgtaataataataatgacatcaaatgcaggtgcaaaaaatattggaaagaaacttattggttttggtgatagagaaattcaaggtaatgctattatggaagaagtgaaaaaattctttacacctgaatttagaaatagacttgataaaatagttgtatttaatggaatgaatgatgaaatggcaaaacaggttgccatgaaaaagcttaatgactttaaaaagaaactgtactctaagaatatagaaataatatttacacaagaatgtagtgattatattgctaagttaggaacttcaaaagagtttggtgcaagagagataataagggtaattgattcgaatataaagcctctatttgtagatgagatattatttggaagtttatgtgatgggggcaagtgtagaattaatcttataaataataaatttgagcttgaagtgctgtaagctagattagtgtgaaaatagtaaataataattttttataatttatgaatatattatttaaaataagaaataatatatttgtcgaagctaaggctttaagtttttataggaggtgaactgttgcagagtatatatatattctggcaatagaaagttaaaatggaagatagaaagatagtatgtaaagattgtggagaggaatttatctttacggttggtgaacaagaattttataaagaaaaaggatttgaaaatgatccagtaagatgccaaagttgtagaaaagcaaaaaaacagcatcataatagataggctattagtctatattgaggagttataacatcattaaggagttataactccttttatgtttctatttgctttagataagaaaatatgatttatttaaaataatatataaaatactattgaattatttatatatttgagtttataataataaataaagattcaaacaaataattatttgaaaatgaattatattttgaaaattaatttagttaaagatagtgataagaaagagtaattttagatatactttttagagagctgaagtttggtgtgattcagtaagtatacttaaatgaagcagtctttgaatttcatgctgagaactaagaatatatattcttaattaggttatgacgtgttccttacgttacaaaggatagaatgtttagttgacattcttactgagtgaatagcatacgtgctatttattagggtggtaccgcgaagtagttccttcgtcccttgtggatgaacggaattttttttatttaaaaaattatataaaatgaaataaagtcaaagttatctaagtgatcatattatcagtaatataaaatcaaaatgaagtagtataactgttaatggacaattgttaactaaataaattggagggatttgcaatggaggaaatactcgaaatattagaaaaaaatagtagatatagtgatgagcagattgctgtaatgacaggtaaaactgttgaagaagtacgtgatgcaattagagattatgaagagaaaagtataattgctggatatactactcttattaattgggaaaatacaggaagtgaaacagtaacagcattaatcgaagttaaaatcacaccacaaagaggtgaaggctttgataaagtagctgaaagaatatataaatttccacaagttaaagcgtgttatttaatgtcaggaggatttgaccttactgttatagttgaggggaagactatgaaggaagttgcactttttgtatctgaaaaacttgcagttcaggaatatgttttgagtacaggaactcattttgttcttaagaaatataaagatcatggaacaatctttaaagaaaagagagtagaagacagggaggctatatttatatgatactagaaaatatgataagagataatgttagaaacatgcctccatcaggtataagaaaatacttcgatatgataaatgaaatggaagatgttatttcacttggagtaggtgaaccagattttcttactccttggaatgttacagaagcaggaatttattcgttagagcaaggacatactcattattcatctaatgcaggatttattgaattaagaaatgaaattgctaaatatttatatagaagatttgatttaagttataatccactagatgaaataatagtaacagttggtggaagtgaaggtattgatattgctcttagagcgttagtaggacctggagatgaagttatagttccagaaccaagttttgtggcatataagggatgtactgcatttactggtgctacagctaaagttcttgatttaaaagctgaaaatgaatttaaacttacagcagaagatcttgaaaaagcaattactcctaaaacaaaagttgttatagttccattcccaaacaatcctactggtgcaataatgacaagggaagaacttattccaattgttgaagtattaaaggacaaagatataatcgttatttcagatgaaatatatgcagagttatgttatgatgaaaaacatgtttctatagcatcatttcctgaaatgaaagagaagacacttgtaataaacgggttttcaaaagcatatgccatgacagggtggagattaggatatctttgtggacatcctactttaataaatgaaatgaaaaagattcatcaatatgcaattatgtgttcacctacaacagctcagtatgctgcaatagaagcgcttaaaagtggagattctagtatagaagaaatgcaaagggaatataatagaagaagaagagtacttgtagatggttttagaaaaatgggattagaatgttttgaaccattgggtgcattttatgtatttccaagtattcaatctacaggaatatcttcagatgaattctgtgagcaacttcttataaatgaaaaagttcttacggttccaggtaatgcatttggggattgtggtgaaggatttataagagcttgctatgcatcatctatggaaaatataattgaagcattaaaaagaattgaaaagtttgtaaatacattaaagaaaaagaaagcttaaatttaactagattatttttagtatatataaataaaaatataatattaattacataatgcgtaataaaaagaataacttttattacgcattattcttattatgttaaatgattgagctatatggaattagaattttataaatttaatttgacatagattatgtctattttgcagaaaattataggattttgaaagatgaaaggttatattgtatttagattccagcctgcgaatgttttaagttaaagaataaaaagtaaaattaggctgattctagagtaggattggaaaatttgattaatacatgataaaaaaatagattaattgtatttataataatcataaaaaggattgacaaaatatgtttgtaaatgttatcataattttacaaaacaagtagacaagctacgatacaagttttgggattgtgtaaaagtatggaaaatatatttaagaagtggaaagttcgtcataaattattcagaaaattctgtaaacaatataatattcatgtatgttaagggaatttgataaagattatctgatttttaaaagactaacttgaaaaaaatgtatgtgatatactattagcttttattaaaagaaaagtgatactattttcgttgacaaaagatatacggatatattattattaatgtggaagcgctaccatattgactaaataagatataaaaatgcagtaaaatcactattatgtcgaaaaatgaggtgaatttatatgcctgtaactataagtgatatagcaaaaaaggcaaaggtatcacagtcaactgtatcaagagtattgaatgactctggatatgttaaagaagaaacaaagaacagaatagaagcagtaattaaagaattaaactatacgcctagtgctattgcaagaagtttatccaaaagagagacaaatgcaattggtgtaatagttccggatataactaattcatattttggagaagttattaaaggtattagtcaggtggcagataaaaataatttaaatataattttttataatacagaaaattcgtttgaaaaagagattagagcattaaatctgcttaaagagcagagaattaaaggaataataatgaccccaggttttggagcagatgattttgatagcacatataaagaaattattgaaagtttacaatgtccattgattttagcatgtgcagatgttaactcaacagaacttaatggtgtttttgttgataatattaaaggagcttatgattctgtaaagttattaattgaaagaggacacaaaagaataggaatactattaggacctttaagctcagaaccaatgagccaaagacttttaggatataaaaaagcattaatagaaaataatataaaagtaaaagaaaactatatactaaaagcagattttacatgtgaaaatgcatatgaaattacaaaagaaatgcttgatagtaaagaatgtccaagcgctcttatagtatgtactaatagaatgactatgggtgtcatcaaagctgtagaagaatataaaaagaaaatacctaatgatttagccattataggttcagataaaaatgatgtattagatatgtttgggctaaaccttacatatattgaagagtgtccactgcttttagggaaaagtgcaatgaagttgttgtgcaatattttaaatgacagtaaaacagagaagacaaggacaataatatcgcctcaaataataataagaggttctgaaagatttgagtaatcaatccatatggattgtatacatattttataaaaaaactctaatactaaaaaatgatatctaaagaaattaatacattgcattaaaatcaggatttatttctgtgattttatatattactaaataaaatgctatactttaggaggtatttataatgaaaaagaaattactatcattattagcagtttcagcaattacagtaactttatttgctggttgcggaagttcgtcaagtactggagatgctactggtacagatgcaaaagtaaaagttggtatggttactgattcaggaactatagacgataagtctttcaaccaaggtacatgggaaggtattgaaaaagctcaaaaggattttagtttacaagatcctaaatacttaaaaccatcaggagaaactaaagctgattacttaaaggaaataggaaacctttatgatgcaggttacagactaatagctactccaggtttcaaatttgaaacagcagtatatgaagctcaagataaatataaagatgctaactttgtaataatagatggtactccaaatgatggagcagaaaaagatccagttgttaaagtttcagacaatgcagtttctattttattcgcagaacaacaagcaggatttgttgcaggtgttgcaacatctgttgaattaaaagaaggaagccttggatttattggtggtatgaagattccagcagttcaaaaattcaactggggattccaacaaggtgtagcatatgctaatgctaacttaggaactaaaatgactttagataaagaaaatgtaatatatcaaggaacattcaatgatgttgctgcaggaactcaattagctaatgctatgtatgatagaggtgttaaggctatattctgtgctgctggtggagttggtaatggtgttataacagcagctaaaactcaagtggattcaggtaaaaacgtatgggtagtaggtgttgacagagatcaatatgatgatggtaaatatgcagatggtaaatcagtagttcttacttctgctataaagaaagttgattcagcaagctatgatatggttaaacaagtgttagatggaaatttcccaggtggtaagacattaacatttgatataactaaggatgcagtaggtattccagctgaaaatccaaatttaagtgctgatacaatgaaggttgtaaatgatatttacggaaaacttaaagatggatcgattactgttaaagataacaatgatgataactcattatttgaataattaaaaattactataaatttattaacaatgggaataagtagtttataggatttctatatcctataaactaaacctcattgttaatttcataatgagataaatgatgaaaatattgacaattgacaatgtacaataatggtagatggggattaagttgtgtggtttaaaatatattgtttattgtcaattgtcaatcaatattgttaattaataaaggaggatattattaatggaatatgtagttgaaatgctaaatatccgtaaagaattcgcaggtatagtagctaatgataatattaccttaagattaaaaaaaggtgaagtacatgcgttgttaggagaaaatggagcgggaaaatccactttaatgtcagtactttttggaatgtatcagccagaaagaggaataataaaggtaaatggaaaagaagttaaaatttcaaatcctaatgttgccaatgatttaggaattgggatggttcatcaacattttaaactagttcataattttacagtaacagaaaacataattttagggtgtgaacctaaaaagggaatggttgttgatgtaaaaagtgcagcaaaaagagttgaagaattatctaaaaaatatggtttaaatgttgatccatatgcaaaaattgaagatatatctgttggaatgcaacagagagtagaaatacttaaaacactttatagagatgctgaagttcttattcttgatgaacctacagcagttcttacaccacaagaaattgatgaacttatgaaaataattaagaatttaatcaatgaaggaaagtcaataataataataactcataaacttaaagaaattaaggcagtagcagataattgtactgttattagaagaggtaagtatataggtactattaatgtaaaggaaactagcgaagctaaaatggctgaaatgatggttggaagaccggttaattttaaagttgaaaagcagcctaaaaaagctggtgatgttgtattaaaagttgaaaatttatcagttttaaataacaaaaaagtacttggtcttaagaatttttcaattgaagttaaaaaaggtgagatacttggtattgctggagtagaaggtaatggacagacagaacttattgaagctattactggtatgagacatgtaaaagaaggaaagataatacttaaaggtgaggatattactaacatatcaatacgtaagcgtattgattctggtatcggacatatcccagaagaccgtcaaaagagaggtctagtattagattatacattagaaaataatatagttcttcaaaggtataataaagagccgttttctaaatatgggctactacaaaaagatgcaatacatgattatgcagaaaatataataaatgaatttgatgtaagatcaggtcaaggtggagcatcacttgcaagaacaatgtcaggtggtaatcaacagaaagcaatcattggacgtgaaataggattagatcctgatttattaatagcggttcaacctacaagaggccttgatgtaggttctattgaatacatacacaaaagattaattggagaaagagatgctgataaagcagtattacttgtatctttagaattaagcgaagttatgaatttagcagatagaattgctatagtaaatggcggtgagttaatcggagtagttaatgcagctgaaactgatgaaaatgaaataggattaatgatggctggtgttcataaaggaggatcaaagcatgactagaaaagaagctttaaattctgtaattgcagttgctttggggttaattgcaggagcaattttaatgttattaattggagataatccagttgatggatatatgtacctttttaaaggtggattaatgaatgtacaaagaattggtgatactttagcaacagctactccacttatttttacaggactttctgtagcatttgcttttaaaactggattgtttaatataggaactccaggacaaatgttatttggaggattctgtgctacaagtattggattattatatagtgatagtatgccaagatttttattattaattcttatggttcttgttggagctttagctggagccttatgggcatttgtaccaggtcttttaaaagctaaatttaatgtaaatgaagttgtatcatcaatcatgatgaactggacagcatactggattgtttattatgcagtaccagcttattttaaaggttctacagaaacagaatcaaaaaatattcctcaagtggcatcattaaaagctgaatggcttacaaatctttttgatggatcatatataaatttaggattaataatagcaatagtagttgtaattttaatttggtttattttgaataaaacagttttaggatatgagttaaaagcagttggatttaacagagatgcagctgaatatgcaggtatgtcagttaataaaaatataattttagcaatgatgattgcaggtgcattatcaggtttagccggtgttgcacaatatataggtaatgcatcaaatattcaaataggtataatgccttcacaaggatttgatggtatcgcagtatctttattaggtgcaaatagtcctctgggagtattagtttcagctatattctttggtttgttatattctggtaagggattcatgaacgttaatacaagtatacctccagaaatagcagatacaataattgcaattataatttattttgcagctataagcgcagcagtacctatgattgttaagaaattcaaacaaagaaaagctcaaaaagctggagatagtggtagtggtatactaccaaatgataataatgtagataaggaggaaaaataatatgtggtcaataattagagatatatttccatatgctattgtgtatactattcctctacttataactgcacttggagcgttatattgtgaacgaagcggtgttattaacataggtttagaaggatttatgataattggttctttttctggagcactagcaatatcaaaactacaagaaagtatgcctgaaagttctcttccattatggattggattattagtggcttttattgtaggaatgctattttcactattacatgcatttgcaagcataaatttaaatgcagatcagacaataagtggtacagctatcaatatgatagcgagtgcattaactatatttttggcaagaactatagcaggaagtggacgtataagaatacaaagtggattttatcctaaagatgttccattcttatcacaaattcctataataggagacttattctttaaaaagacttatataacaacatggttagtacttttaattttagtgattagtatattcttattatataaaacaagttttggattaagacttagagcatgtggagaacatccacaagcagctgatgcagcaggtataaatgtttttaaaatgagatattttggagtattactttcaggtggtctttcatctttaggtggagctattattcttgtaacatactcaggtgaatttaatggaagtgttgcaggtattggattccttgctttagcagctttaatatttggtcaatggaagccacttggaatacttgcagctacattattctttggatttgctacaacagttgcaaatgtatcacaagttattccatcattaggatcaataccaccagtagtgttaaaagtattcccatatgtggtaactttaattgctttagtattattctcaaaatcttcacaagctccaaaagcagctggtgaaccatttgatgcaggtaagagatagaacttagaatttatatatataatacatgttgctattgtataaattgatttaataccatagcaacatgtatggtatatagattgtctatgcgaagatagtatataatatatactaatatttcaatttataaagatttaattgaataggggaattaccatggattataaaaatcttgttaaaacagccttagattatagagagagagcttatgcaccttattctaactttaaagttggcgcagctgtattatttgaaagtggcaatgtttacggtggatgtaatattgaaaatgcttcttttggtgcaacaaattgtgcagaaagaacagcaatatttactggagttgctagtggcgaaactaaaataaaggtaatagccatagctggaagtgcagaagagtatacttatccatgtgggatttgtcgccaggttttatgtgaatttgcagatggagatgcagctgtaattttagttaaaaatgaagacgattatatagtaaagagtatggaagaagttatgccaggagcttttagaaaagaaaatattagatagaaatatacggaggtttacaatgagtattcatataaatgcaaaacaaggagaaatagcagaaagcgtattattaccaggagatccacttagagctaaatttatagcggaaacatttttagaagatgtagtatgctataacgaagtaagaggaatgtatggatttacaggaacatataaaggaaaaagaatatcagtacaaggaacaggaatggggattccttcaatttcaatttatgcaaatgaattaataaatgaatatggagttaagaatcttataagagttggaacatgtggaggataccatgaagatgttaaagtaagagatttagtaatagcaatgtcagcatgcacagattcaaatcttaacttaacaagattccaaggaagaacatatgcaccaacagctaattttgaattactaaaaaaggcatatgatacagcagttgaaaaaggaatagatcctaaggtaggaactatttatagttcagatatattttatggagatgacaatgaagattggaagaaatgggcagcttttggatgtctaggtgttgaaatggaagcagcaggactttatactgtagcagctaagtatggagttaaagcgttagcaatcatgacagtaagtgatcactttataacaggtgaaattacaagttcggaagaaagacaaaagacttttacaaacatgatggaagttgccttagacacaatagttggattagataagtaatagttaaaaggtaaatgctttgaagctgtattaggctttgaagcatttattttaatatatagaaaattataattgtaaagttcatagtacaacatatataattaataaaaaaagagaaattgaactattttaaggagaaattatatgaacatacaaatctttggccgaaaaaaatgttttgatactaaaaaagcagaaagattttttaaagaaagaaaaataaaatatcagcttattgatattaatgaaaaacctatgagtaatggtgaaatgaacaatgtgctcagatgtgtagatataaatatattaataaacacaaaatcaaaggattatattaagctaaattttaataatataagaagcaaggaagttaaaactgaattattactgaaaaatcaaaatgttatgaatactccagtggtgagaaatggtaataaagctacagttggtgtagatgaagatatatggaaaacatggatagatgaaaataaataaaagtctttttaaatgcatactaaactgattttttcttaatactaaaatgaatagtattttagaaaggatgtgaagttttatggcaaaagcaggaatgagaagaccagatccaagtgatgctcatggaacagaaagtaatcataaacagcattataagaaaaatgatgtgaaagatattccgacagaaatacaaggaaaagccaaaacaggtaatgctaaggctggaacaataatttaatataaataaaaatattaaattacttgatttgttgatgaaggatgaatttttatatattcatcctttattacatattattatgatattatataggaaatagagtaattattatttaattaatattaataaaagatagaaggagaaattatcacaatgtatattattaattttataagaggattttgtatggcacttgcagatagtgtgccgggagtttcaggaggaaccatagcatttttattaggtttttatgataagttcataggttctcttgatgctattgtagctgggaaaaaagcagaaaaaatagatggaattaaatttttgataaaaataggaataggatggatagcaggctttgttatatctatgttatttctaggatcaatttttgaagcacagatatataatataagttcattatttttagggtttataatttttgctattccaataataattaaagaagaaaaagaaagtttaattgataaatataagaatgtagtttttttaattggaggaataattatagtatctgctataacttattttaatcctgcaactaaaggtggaatggatatatcaatagatagattatcaataggattaggagtatatgtttttgtagttggaatgatagcaatttcagcaatggtacttccaggaatatcaggttcaacattattgcttatatttggtctttatgtaccaattgtatcagcagtaaaagaagttattacttttaattttgactatttacctatagtaatgatattcggatttggagtacttggaggaatatttgcaactataaggattgttaaatatgtattgaataactatagatctcagactatctacatgatattaggtcttatgattggatcgttgtatgctgttgttatgggaccagcttcattagaaattccaaaacctccaatgacttttagtacttttagtattatgttttttattataggtggtattttaatattaggtttacaacaaatgaaaaacatttttgacaaaaataaaaaaatatagaataatatacataaaaatacaaagtatttacattagaaagaaaaaactttgtttttaaataaggaattatgtggatagggtggatggtatggggaaaaaaataatatcgattgctttttcagaattaaaaaaaggtatggttatagctaaggatgttgaacaaaacggaaaagtgttgttaaaaaagaacatggaaattacagagaagatgataattgatatacaacgattactctttataggaactgttcaagtttatgatttagaaagtatgcaaaatgaaagcacatttgaagaaaagaaactagaagaattcaataaaatagaggaagaatttaaagttatttcttcaaagttacaaagaacatttagaagcatacaaaatgaagatagtgaatgcatgaaagaaattaggatattttccaataaaattcaagaagaattaaagccaagtagtgttgtaattaaaaatattgttctacatggcagtggcagtgattgtatttataggcatggtgttaatgttgcagctttaagtgcattaattggaaagtggcttggatatgatggagcacagcttaatcttcttgtatattcagcaatacttcatgattttggaaagacaaaagtgaagagagaaatattgtataaacaaacagctttaactacaagtgaatataatgtagtaaaaaatcatccggtactgggatataactttgtaaaacaaattccgtttttagataaatgtgttagttatggagttcttatgcatcatgaaagagaagatggctctggatatccattgggattaaagggggatgctatacattcttttggtaaaattattgccatagcagatgtatttgatgctattaattctaatagaggctataaaagaaaaaaggctccttttgaagcattgcaaatagttaaaaatgaatcgttaggaaaacttaattatgaatatgtaaaagtctttttagaacacatagtaaattattatttaggagaagaggtacttctgaataatggtgagagatgtaagataatacaaatgaatattaataatttagagaagcctttagtgcttaagaatggagaatttatagatttggacaagcagaaggaatattatattaaagaaatgctgttataatttgtaattataactatattactaaaaaatcttttaactaggttaatagggggaaaaatgaaaaaaggtttgttattaaatgtaagtgaattaaaacagggtatgattatatctaaggatattatagaaaatgggactcttttagttaagaaaggtactataataactgatgaattaatatcactattaaaaaagtcatattttttagagaaaatagaaatagatgtatctgatgttgatatatcagaaaatagcaaagaattagagcttaagaatgtagaagaaagctttaaacaagttgctcatgaattacaggagatgttttctaaaatgaataaaataagaaaaacagatcttgatgaattacgtgaatttgctgtaaggatacaaaatcaacttaattatacagaggttgtagtgtgtaatgttgtttttaagggtagtggaaatgataatatatatagacatggagtaaatgttgctgttctaagcgctcttattggaagatggataggccttgaaaaatctaaaataaatcttcttatttattcagcacttcttcatgattttggaattactaagcttgatcaaaagtatcaaagaaaaccagatattatcatggcagaaaactataaagaagtaaaagaacatgcaaagatagcatataaatgtgtagatcttattccatatttagataagtcagttagctatggagttcttatgcatcacgaaagagaagatggcactggatttccacttggaataaagggagaaaaaattcattactttgcaaaaataatagcaatagcagatgaactagatgtacttaattcctataatgaagaaaataaacctaagggaccttttgaaattcttgaaattttaaaagaaaaaagtttaagtaagcttgattatgaatatacaacaatactattacagcacatttccaattattacatgggcgaaaatgttcttttaaatactggggaaatagctaaaataattcaagttgatttaaataacttatccaagccattacttttaaaagatggagaatttttagatttaagaagtaacaaagaaatttatataaaagaattattataaaaatagtggactgtcattaattgatggtctattattttttttagaatttgaaagtttcgtatagaagaaaaaatattgtatatttataatagtatgtagtgaatttattttattaatattaggagaataaagatgaaatattcagacttaaaaaagagttatattacaaaatcagattgtgaattctgtggaataaaaaattatatatcagcagctaattatagcgaagatatgataaataaagttgaacctgtattaaatagtttaaaaaaaagtggctatattataggaacaaacaatttagaattatattatgaaaaatttatagtagataatccaaaaggaaatatagttatttcccatggaattggtgaatatactgaaaaatataatgaattgatttactattttattaatgctagttattctgtttttataatagaacataggggaaatgggcgttcaggaagattaggaaaagatattggacaaatcagtgtagaaaaatttgataactatattgaagattttaagcaatttatagaagaaaaggtgatacctaatagttataataaaaagataattctatttgctcattctatgggtggggaataggcacagtatttttagaaaaatatccacaatattttaatggtgcaattttgagttcaccgatgcatcaaataaatacaggcaatactccagcgtttattgcagatatgctttcaagaatatgggtttgttttggaaaaggaaatgaatatatgcctggacagaaatcatataatggacagcgtagatttccaagtagatcaacaaattgtgaagaacgatacaattatcaatatgataaaatattaaagaataagtcatttcagacaggaggagcttcagcaaaatggtattttgaagcctctaaggctactagatatattagaaataaaaaaaatatatcaaaggttaaaatacctgtaatattgttacaggcagagtgtgatactcacgttattgctgatgctcattataaatttgcaaagtatgcagataattgtgaggttattattgtggccaatggaaagcatgaaacttattttgaagttgatgagataactattcaagttatatataaaataatgaattttattgaatcaatataattatattattaatataaattttaaagtatgcttttattaatattacaaataataataatataaagtgtattttttatatgatgtggatttttatagtgtaatagttataggatattaatagttttataataaattaaaaaagtagagtcttaaaaatatattctatatgcattatataggaggtttgtgcttatttacctttcttaaaaaaaatggtagaataattatctgtaaataattattattaatattaggaggaagaaaaatgttatttatagagtatccaaaatgttcaacatgtagaaaggcacttaaatatcttaaagataataataaagaagtaatagtaagaaatattgttgaagctactcctactaaagaagaattaatagcttggatagataaaagcgggctagaaccaaaaaaattttttaatacatgtggaaaagtttataaagaattaggattaaaagataaagtaagtttaatgtctaaagaagaaattgcagaaatgctttcaaaggatggaatgttaattaagcgtccaatattagtaagtaatgatgttgttttagttggttttaaggaagaatcatatagtaaggttaaataaattcaaggaggcatttataatgaaaaaggatttgttagagaagggggcagttttgcagagagataaagaaacatatgctatagcacctcatttaactgcaggtatagtatcagcggatgaacttagaaaaatagcagatgtagcggataagtataatgttagtgcgataaaggtgacaggagctcaaaggatagctcttgtaggcttaaaggaagaagatattgattctgcttggggagatcttggaatgagcccaggagctgctataggactatgtgtaagaagtataaaagtttgcccaggaacaactttttgtaaaagaggccttcaagattctgttgcagtaggatcaaaattagacagtttatatcatggaaaaaatctacctaataaattgaagattggtgtaagtgggtgtccacatagttgtgcagacagtgcatttaaggatattggcttaattggaagtggaaaaggatggatggtttatgttggtggaaaaggtggaatgaaaccacgaattgctgacagaatagcattatgtattccagaagaaaatctttttaatcttgtggagaaaatcattgaagtttatgataataatgcaactggaaaagaaagaatcggagactatatagataggattggaattgaaacttttaaaaatcaaatagatatagattcttatttgtaaaaataatgttttatagattttgtagacaattataaattgaatgcaaaatctatttttattttaataaagtttataaaggtattgttaattttaattaggagaaaaataaatttagtaatacatgttgatagataatcttatatagtataggattattagggaataattaatcaaaagtgaaaattaatgataagaggtgaaaattttgaaggaattatttgatcttttttggacatttgctaaaatgggagctataacatttggtggtggatacgcaatgcttccaataatacaaaaagaaattgtagagaagaaaaaatgggcaacagagactgaagtaattgattattatgctgtaggtcaatgtactccgggtgtaatagctgttaatacagcaacatttataggatataagttaaaaggaattattggtggtattgtggctacattaggagttgtttttccatcattagtgataatcatgataattgcagcatttttaaaaaattttgcacaattctcaattgtacaacatgcatttggcggaataagggttgcggttgtagcattaataataagctcagtaataaaactttggaaaagttctgttaaaaattatataggtatattattagcattttctgcattttttttaggggtatattgcagttatcacccatatatgttgtaataggcgcagcattaattgggctattaaagaaaaataaaggaggaaaaaatgaatgatatatttattattattttttgaattctttaaaacaggtttatttgcagttggtggaggattagcaacattaccatttttaattaatctaacatataaatacgattggtttaatcaaagtatgcttgcagacatgatagctgtatcagaatcaactccaggaccaatgggagtaaatatatcaacgtacgcaggttatagctctggaggtattagtggtggtatagttgcgactttagggttaataacaccatcaataataataataataataattgctaagtttcttgaaaaatttaaaaataataaatctgtagagtcagtatttgaatgtcttagaccagctagtgtaggtttaataggagttgctgcttttgaagttgtaaagatagctttattaaatattaatgaatacttagtaactaataatttactagatttgattaatataaaaagttgtatattatttgctataatcttttattctattattaaatataaaaagcatcctatagtatatataggaatttcagcagttgttggaataatatttggtctttaggatattaactgatattatttctagtactatttaaaaaatacagtgatattgtttaaaaataagttaacttgtataagtacgaaatatatatgcaaaattaaagatgtatggagttttataaagataaattccatacatctttgtttacataagttatcttaaaaattgtttaagtatatcggcagcagttgttttatcttttccttcgattatagttttatattcttttaatttcttttcttcttcttcagtaagttttgttccttttcctttcttttcaattaagcatttaaaatctttgtatttttcatcgcctaattttcctttaaaaatacattcaatcataacacttaaagattttttttgatcctcagtaagaggagttcctttttctttacattctttacattcagtcaaagttttcttttgatcagcagataagtatttacaattttcttctgtaaatatgtctaaacccttatctttatgatctttgcccttatctttatttttatctttgtctttttcaccgtctttgcatttgttgtcatctttattcttatctttttcttcatccttagatttatcttttttatccttattagctgtgtaataatatgattcttctaaagaaacagtaggtgtatctgccattactttttgaggaacaacatacatacaactaagaactgccaaagatgatgctatgcaagttactatttttttgttcatcattttacctccgtaaatataaatttcaataatagtatgtgaaataataaaaatttttattatgaaaaatttttattatttcttaagaatatatatatgtaaaatggacataataattagacgttttagtaatacaatgttttaacagttgaaagttatcttcagttctgactggattataagtccttaaagaataaaaaagcatggattagccatgcttttttattataatatgttgaaattatcatattttaattgtaaattgaaacacatatatttaattttgattatttgtagaaatattttcagacgctttttctttttcagaatgctcagaagtattgttttcagaagcattagtattattttcagtttgtgaagtattttcagaatttatatcagtattactattttttgaatcagaatttgaattattagaactatcttcttcagtcttatcagatgatgaattgaaaagacctgagaaccagttttttattttttcccaaaaaccattatcagaaataatatttttaattgcatccttatctgttgcatctacttttacatcatcaccaagcacagtatcattagtattttctaatattcctaaatctttacttccagagaataaatctttgaaccagttaccaattgatgaaaagaaaccttcagaacgatttatatttattccagcttcttgaagatttttatcaactgcatcagaaacatttttaaaagtattttttaagctattataatcataatcttgctcagaaattttagtcattaaatcagatatttgcttttcttgtgatggagttaatgtaatgttatagttgtttgtcacattatttatagtttctgctatttgattggtatctttagtaccattttttataacatcagcttttatatcatttattaatcctgctgcttcatcttgtccaatttcatcacctaaatcacttgttgtaataagttctttagacgcaagttctttcttatcttcgctaagttctttaccagtagcatcttcaaaggccttcataactccagttaaggcaccagttcctgaaacacccccactaagtggtgtcatagcaataacatttgcatcttcaactccacaagtagcaagagtactagcaatcatagaagatgtaacataagtaagatttgcagttttaacatttataccattgcctttttttgcaggttctacataagcacatgagaatgttttagttccgagctgcgcttcacttgcaataccttgaagatattttctctcttcaagattattaacttcaagaataactgcttcatccttttttacaccaaaataatcaagtacagtctgcttttgagtatcacttaaatctgcacctattgtaactacttttgaactatccgcaaaagcacaagttatattaccaaatattaaagatagacagactatagatgaaataaatttcttttttaataccatttttattatctccttctaaaatgaataaattattatgtcgaatgaatttaattactaattctttgatattatagcatataaataattaaattttattaatgaatctcttacttttatcttaacattatattctgagagtgccaaagaattaaaatctcaggttatattttcaaaaataacaaataaatgtataataagagcatagacttaaatatataaaactttttatcgaaaatagaatataattgatgaatttaaggttgaaaaatatatgtattattcttaattaaatataatcaatcagcgtagtactgcataaattataatataagatagaatttacaaacatgttaattcctcgagtttatattaattatatatacatgatgaaaaagtgacttatatgtgtaataaaggggataataatatgaatttatggattgaagatagagtattttataatatttttacattgggtttttgtgatgtattagagccaagcagaatttatgaagaaaagaataggcttataaaaatagaagaatggatacctcatttaaagaaaatgagtataaatgcaatatattttggaccggtttttgaatctagctatcatggatatgatacgcgagattatttgaatatagataaaagacttggaacaaatgaggattttaaagatttatgtaaaaagcttcatgaaaatgatataaagattgtattagatggagtgtttaatcatgtaggacgagagttttgggcatttaaagatattcagaaaaatggtagaaattcaaagtactgcagttggttttcaggattaaattttgatagtagaagtcctatgggtgatgactttaattatgaaagttggaatggatgttatgatctggtgaaattaaacttgtggaatagagatgttgtagaatatttattacatgcagtggaattttggatagatgaatttgatatagatggattaagattagatgcagcagataagattatttttgatttttttaaagaattaaagatatttacggagaagaaaaaggataatttctggcttatgggtgaaataatacatggagattataatagatgggcaaataaagacagtttagattcggtaactaactatgaatgttataagggtatatactcaagtcataatgataagaattattttgagatagcatattcattgaatagaatgtttgggaatggtggaatatataaggatttgtgtttgtataactttgtggataatcatgatgtaaatagacttgcaagcactttaaaagttcaagaatacttatttaatgtttatactattttatatacaatgccaggtgtaccaagtatttattacggaagtgaatacggaattaaagcagtaaaaggtgataaaactgatctgccattacgtccaagtgtagatgaaatagaaaattatgaagataaaaacaatgagttgtttgatcatattgaaaaacttggaaggataagggttgtgagtgaagcacttaagaatggtaactatgaacaagtaattataaaaaatgaacaatatgttttttctagaacaagtaaaaatgataagatctatatagtattaaatctaagtgataaagaaagttatcttgattttaatatatcttttgaagaaggaaaagatttattatctgataaagatgatattattaaaggtggagatgtaagcattagagtaccagcattttcttctaaagtaatagcaaagataaagtaattaatttttataaaagtttaaatggctgtgtttttgtctaaaatgtttaataaaagttacaaaggggtaatactataatgaatttattaggtaatgattataataattatacaggtatacttggtgctcaatattcaaaagaaggcacaaaatttatattatgggctccaaatgctaataatgtcagattagcattgtttggaaaagactgtaaggagtataccaatagtcccgaagaaatattagatatgaacagaggagaacaaggcacttggacaatagaagtaaatagagatcttaatggagaattttataattatttagttacaaacagtggaaatgaaagagaagttatagatccttatgcgaaagctgttggagttaatggaaatagaggtatggtaataaatctaagggaaactgatcctattgatttttgtaaagacgaaaaacctgaattaactagtgcagcaagttcgataatatatgaaattcatgtaagagacttttcaattaatgaaaattcaggaataaaagctgaaagaagaggaaaatttatagctttttgtgaacaagggacaacacttaaaggaaaatatatagaaactggtattgattatttaaaaaggattggaataactcatatacacttattgcccagttttgattatgagacagttgatgaatctaatttagaagttccacagtataattgggggtatgatcccaaaaattattttgtacctgaaggttcatattctactaatccctatagaggtgaaaagagaatacgagaatttaaagagatggttcagagccttcacaaaaatggaataagagttattatggatatggtatataatcatacctatagaactcatgattcaaatttaaatcttgcagtacctggatattattacagacaagatataaatggaaatttctctaatggttcaggatgtggaaatgaactggcatcagaaagatatatggtaagaaagttgattttagattccattttatattgggcaaaggaatatcatattgatggatttagatttgaccttatgggtcttcatgatattgaaaccatgcatataatacgaaaagaacttgatgcaatagatccttcaattttaatgtatggagaaggatggacagggggtggaacacctcttaaaagtgatcaggcagcaataaaacaaaatataattaaatttgaaaaaagtcagattgcagcttttagcgatgatacaagagatggtgttaaggggcatgttttcaatataaatgaaagaggatatattaatggaagagaaggtcttgaagatacaataaaattttgtattgtaggagcaacagggcaactaggaattaattatgatagagttatatattcacattggtcatgggctaatgagccttatcaatgtataaattatatatctgcacatgacaactatactctttgggataagttgactatgtcaaatagagaagattccatagaaaaaagaaaaagtatgaacaaacttgcagcagcaatagttcttacttctcaaggaataccattttttcaagctggagaagaatttttaagaagcaaaaaaaatgatgatggaagttttaatcatgatagctacaatgcaccagataaagtaaatggtttagactggaatagggcatatgattatagggatattgtagaatattatagaggattaattaaattaagaaaaaaatatagagcatttcgaatgaattcaagtgaagaaatacgaaaaaatttatcttttttgaataaaggtgaaagcttttataaagacaatgtagttgcatacaaaatagaagataatagtggaagaaatttatgtaatactatagtggtaatatttaatcctaatgatgaagaaacttttatagatttaaaagaatgtggatggagtgttcttgtaaacaaagaaaaagcaggagtagaagaaatttattcaatagagggtaataatataacagttccatcaaaatgtgcacatgtattgataaaaaaatgagataagaaaggtctaaggtgatataagtggaagaaaaatatttaatatttttgaatgatattagcaaagataaaccaaatgaatttgcaaatttaaatatgaaggaatgtcctttttgcaatagagaagagttaaaggatgttattgatgaaaagggtccatttatattactaaaaaataaatatcctacattaaaagatacatgtcaattagtgataattgaaacttatacttgtaaaggaaatatgagtgagtatactgatgaatatattcagaatctcataaaatttggtgttgaacattggcttgaatttgaaaagaataataattataaatcagtaatattttataaaaatcatggtccacattcaggaggaagtttgaaacacccacatatgcagatagtaggtattagagatatagattataaattagatttaaaagattcgtattttgaaggtatagagatttataaaagtatctattgtactgtaaatctgtcagataaaccaataagcggtttttgtgaatttaatatgataatagatgagaacttatctggattagatgaactttcaatatgtttaaaaaagataacacactatatcttaaataattattttgcaccatgtgatagttttaatgtattcttctatcattggaaaaataaaataatttgtaaggttacaccaagatttacaacatcacctttattgctaggatataatataaagcaaattccaagttctagtggtgttatagcagataaattaaaagaattatatttctaataaataaaaaaatcgttaaggtaatttatattataacttatatgtaaaaaaaatgcctcgcttaggggtgcgaggcatttaatttaaccatttgctggttaaggggtaaataataatgctttaactactttacaaatactattatgaatgatttatgtgtcaaaaatgtgacaaaaatatgaaaaaatcattaacaaatatgatataataataaattagttcaaaagaatatatttattaggatggtgttttatgaaggaagcagcacttattgttaaatcagaatttgtcacaaaatataaaaacggatatccacttgtttctagggatactttggaaaatccacaggttcttagtgaagaaggacagataataactttactagataataaaaagtcatttataggaaaaggatattatggaaatcagaataaagggtgcggatggattttaagcaatagtaaaaatagtgtatttgactataagtttttttataataagctccgaaatgcattttctaagagaatgaagctttatcattctagacatacaaatgcatttagagtattcaatggagagggagatggtattggaggattaaccattgattactttgatgaatattatttaattacttggtatagtaagggcatgtacatatttaaagattttataattaaagcaatgagacaattagtatctatagatggaatatatgaaaaaaagagatttgaagacaatggaatggttgttgatgaggatagttatttatggggaaagaaagcaccagagcctcttgttgtaaaagaaaatgatgtaaattttgcaatataccttaatgatggagcaatggttggagtatttcttgatcagaaggatgtaagaaaatcattaaaagaaaaatattcaaaagataaaacagtacttaatacattttcgtatactggagcattttcaatggctgctgcaaggggaggagcaataactacaagtgttgaccttgcaagtagaagtcttgaaaaaacaagagaaaattttgaaattaatggtattgattataaaaagcatgatattgttgttgaagatatattccattactttaaacgtgcagcaaaagaaaatttaaaatttgatgttgtaatattagatcctccaagctttgccacatcaaaagataataggtttagtgcagcaaaagattatactagtcttgttaaaagtgcaattactttaactaatgatgaaggtataattatagcatctacaaactgtgcaacatttaatatgaaaaaatttaaaaagtttatagatacagcatttaaggactttaatagagaatatgaaattttagaagaacatacattaccaaatgactttgccgttagtgataaatttccagaaggaaactacttaaaagtagtatttatacaggtttattaaatctagaaaagaataaggttcatcagaaaaagatgacttaatattaaaaaataaacagccgtatatatggctgtttatttttttaaatataatttcgtacgataattggtttattattttttatataaactttaggaattctgtgcttaaacatacataacacttcataatttatcgtgccaagtatttgagcataatcatcagcatttatttttaaattttcaaattgacctaagataataacttcatctccagttttaacagtaccagcatcagttacatctatcatacattgatccatgcatattctacctactataggcactaatttaccattaacaattactttagctccaggaatgagtaatcgtgaatatccatcagcatatcctattggaatagtagctataatgctttttcttttagttttaaaagttctgccatagcttatatacatattttcatccatttcttttacatgagctacttttgcttttattgttaatgctggttttaaagaaaggttttctttctttacttcatgagaaggataatatccataaagtattattccagctcttaccgcatctaaatctttaaatgtttcaggcatatccatgattgctccactatttgaaacgtgttttagcggaatacttatatttagcttagaaagttcgtgtgaaaaattcatgtatttatcaaattgttcaagagtataatccttattttcttcatcagcagtggaaaagtgtgtaaacatacctattacatctaatcctggtaaagagcaaatttctgatacttcttttaatgaagtttcatttgggataaaaccaattcttcccatgccagtatcaagtgctatatgaattttagcttttttattaagtgaaagagcagtttttgataaattttgagcatattcaagactataaacagtttgctcaatatcgtaagttattaactcttctcctaaatattcaggagtatatccgagaatcataataggtgctgttattttagcttttctgagttctattccttcagttaatactgcaacagcaagtcttgaagctccattttcaagaaggacaggagcagtatcaatggcaccatggccatagcaatcagcttttacaacagcaattacttctttatcttcagctaatgattttatatttttcatgttgtatgctaatgcatctaaatctatttcagcccatacgggtctaagtatcttttccatcaataacacctcaaatttactaaaaaattatgtcaataattaattttctttattttagtttaatacaattagccatattattaaagaaccactaatattaaatttttaagcagaggtggttttgcaactttatatttcattttttaaatctgttagtttcaatatatttttaccaatgattttcatacctttttctatatcttcatcacttacacgtccaaatccaattcggaaagtatttttgcaatcattgttactataaaaaatatctccaggcataaatgttactccatctttatagcataaatccaaaagttctcgtgtatttatattttcttttaattttataaatacatgtaatccgccttcaccagtaaggtactcataagggatatatttctcaatcatatccataacaagtgaaaatttatctttataatattttcggacattctttaaatatcgattaaaagctccactttttaaataataatagaaagtactttgatctagaaatgaagaatgaatattacgtcctctttttacactttcaagaatatcaataagttctttatcagcacatatccatcccattctaagtccaggaaataggatttttgaaagacttccaatatagatgactccatttccatttccacataatgaagcaattggatctataggtgagctagtataaagcaattcttcattaaagccatcttctattataggaacttcatatttcataaatagcttatatatatcattacgtcgttctgttttagtaactattccagtaggattattataagatggaattagatatccgaatttaggcttatgagactttaatgcatcttcaagaagggataagtttaatccttcattatccatttttatctgtactatttctaatccataggacttcattattttcagagcagtattatgtgttggttcttcacatataacaacatcgcctttttctgttagtgaactaattataatgtcaaaagcttctgtaaaaccatttgttataagtatatctttattgtccatgtgaactcttttttcactcatatattgtgataaatattctaagaggggtttataccctttagcataaccatagttaagaagatttacgctttcatagctccaggcatctagaagtgaacgtttaaaatcatctagattaaacaaatggctttcgggagcaattgatttaaaagaaatcatattcttttttgatggaagctcactttttacaatatcaagatctcttaatttctttccataatcattaatctttgatttatagttaatattaaattcaatattatttttttcacattcaacgatgataaaagagcctattcctcttttggttacaataattcctttactttctaattcttcataagctgaaataacagaattacggcttatttttaaaaatttactgacttctctagttgaaggaagtttactatttttatttatggttccatttcttataccactaagaatatgattttcaagctggaggtaaataggctcgtttttatttatttttaatgtggaaaatatcaaagtaaatcaccccatataagttttgtattaaaataattataattttgtactctaaattatagcatataaatttttgtttaacatgattactgagttgcaaatataaagtatgtactatatagtgtatttatatttcaatttagaataggagtatgctttatgcttaatgttgacaatatgattgctattttttatgaatataataatatagcatttatcatatctatagtagttagtattataattgctcttataggtatactaccatcagtttttgtaacatgtgctaatataattttttttggaccagttaagggtttttttatatcccttgcaggagaaactattggaggatatataacatttctagtttatagaataggtataaaaaaggttgcatcagattttataagcaaatataaaatcttagataaattacagaaaagtagagggataaaaagtggtttgattatatttgaagggagacttttgccatttattccttcaggttttgttacacttgcagcatccatgagtggagttgaaggctggatgtttattttagcaactttattaggaaaaataccttcaatatttttagaagtaatgataagttatgactttataaatattgaagaaaactatttaagattatttttgagtcttgtggcaataatactgctatacataactttaagaaaaagaaaaatataactcattatgaaaattaatatactatataatttttataagtattaattagaggtatcttggataacttaacaatgagaattatattaagtatcaaataagtgaaatatgtatttaaaatttaatactgttaagttaatataatagtatagagttgttaaaataagttaattgataaagtttagaggtgagaagttgggtaatataggaaatgaaaaaaatgaaaataaaaatgaaactattaagaaagtagtaaataaagaaaataaacataatgaaaagaaaaagtatatgaaaaaaaagctttctccattacaaaaaaagatcaaaataattcctttaggtggtcttggggaaataggaaagaacatgacagcttttgaatataaagatgaaattattgttattgattgtggattagctttcccagatgaagatctttatgggattgatatggtaatacctgatataacatatttagtaaaaaataaaagcaaagttaagggaattcttattacccatggacacgaagatcatataggggcacttccatatatattaaagcaaataaatgtacctgtatatggaactaagttgactttgggtcttatagaaacaaaacttgaagatcatgaaatgcttaaggattgtactttaacagaagttaaacctactgaaattattgaatttgaaaattttaaagctgaatttataagaaataatcatagtattgctgatagttgttcaattgcattacatacaccaatgggaattattgttcatacaggagattttaaaattgactttactcctattgataatgaagttattgatcttcagagattagcacagcttggaaagcaaggtgtactgttgcttatggcagatagtacaaatgctcttcataagggatacacaatgtcagaaaagactgttggagaaacattagaaaatctatttggaaaagcatctggaagaattatagtttctacttttgcatcaaatgtacacagattacagcagattagcaattgtgctttgaaatataatagaaaaatagcatttagtggaagaagtatggaaaaaatctctgaagtagcaagaagattaggatatcttcatataccagaagatatgataataagcttggaggagataaataattatcctaatgatagaattaccattgtaactacaggaagccaaggagaatcaatggcagccttaacaaggattgcatcatcgactcatagatatgttcaaattgaaaaaggtgatatggtaataatttcagcatcaccaataccaggaaatgaaaaagcagtatctaatgtaattaatgacttaactgaaaagggtgcaaatgtaatatataagtcaatagaagaaatacatgtttcgggtcatgcatgtgaacaagaattaagattaatgcaggctttattaaaaccaaaatttttcataccagttcatggtgaatttaagcatcttatgactcatggccgtatagctgaaagtatgggagttaataaagataatatattcatgcttgaagttggagatatatttgaattaacacgaaaaagtggagtagttactggcaaagttccatcaggaagagtacttatagatggtatgggaattggtgatgttggaaatatggttctaagagatagaaaaaatcttgcagaacatggtatgataacagtagtagttgccatagataggcgaggtaaaagtatagtttgtggaccagatattatttcaagaggttttgtatatgtacgtgattcagaagttttaatgaaggatataaaagatattgtaagagaatcagtttataactgtcttcaaaataatataacacagtgggcagaaattaaaaattcaataagacgagaagttgatacattcatatataaaacaatgaaaaagaaacctatgattcttcctgtaatagtagaattataattagattatttattaaaattacaatttaaataagccatgaatttatatgtaagtaaattcatggcttattttaaggctttttaagctaatcctaaaagccttactgtgcttgtaaatacaaagcaaataatcataccagttatggtaggaacaagaaatgatattaatgtccatttaaaactttgagtttccttttttattgttaggcatgtagtactgcaaggccagtgcataagacaaaatagcattacagatacggctgttacccaagtccagccattagcagagagcaaattatacaattcagttgtacttccaagttctaaaaggcttcctgtagccatataactcattataataattggaaatactatttcattggcaggaaatcctagaataaaagccattaatatatagccgtctaaccctagatagtgtgcaaatggatctagaaaatttgcacaatgagtaagaatgcttaagtcacctatacttatgtttgccattacccaaattataattccagcaggcgcagctacagaaatagctctgactaatacaaaaagtgttctatcaaatattgaacgtactataatcttacctatttgaggcttacggtatggtggaagttctaatgtgaatgttgttggaattccttttaaaattgttttggataaaagttttgaaatcataagtgtcataaaaattcctaataatattactagtgttaataaaactgtagaagcgagtgatctgaatggccctataaatattcctgtaaaaaacattgtaataatagttataagagtaggaaaacgtccattacaaggaacaaaattattagttattatggctattaatctttctcttggagagtctataattctgcatccaacgattccagcagcattacatccaaatcccatacacattgttaaagcctgtttaccacatgcatttgattttttaaagaaattatctaagttaaatgcaactcttggaagatatcctaaatcttcaagtaaagtgaatagagggaaaaatattgccatagggggcagcataacagcaattacccatgcaagagttctgtacattccttgaattaaaataccttccagccatgatggggcacctatatataaaaataattcagtaagtttatcttgaatagaaaataggaattttgaaagaagttctgagggatagtttgcacctgttattgtaatccaaaaaattatacctaaaagcaatatcataagaggaattccatatttttttgaagtaattatattatcaatttttcgatctttatcattatattttgaattactaactgacagtaccattttacttatagattcagattttaatactaaagatgatactatttcatcttttaaatttttttcatcaatattattttgaatgagattttctttggctagtttaattgaatcagtaagttcaggattatcatatatattaaaaccaatatgcatatttattgattcaatgagggatttatcattttccaataattttagtgatacccatcttgaattaattttgccatttaacaatggctttaaaactttctgaattatagaaatagaattttcaatagcttggttatattttatttttacgggaatattaattattttattaatagtaatattgtggacagaattcataaggtcatttaaaccttcacctttagaagcactagttgaaactacaggtaagcctaaaagcatggacaatttattaatatttattgatatgccttttctttttgcttcatccattaggtttacacatactagaacattgtttgttatttcagttgtttgaagtacaaggtttaaatttctctctaaacatgtagcatcaagaacgattactgtaagatctggattaccaaaacaaatgaagtctctagcaacttcttcttcaacagaattggccataagagagtaggttccaggaatatcaactaaagtaaattgaaaatttttaaaggtataacttcctgttgcatttgtaactgttttcccaggccaatttccagtatgttgatttaaaccggttaatccattaaaaatagtacttttaccaacattaggatttccacctaaagcaattattttagtattactgttacgcgtaagattaagagttttatctaaagcattagcaccggtagactgattagttaatcccatattaatctcctttataaatttctggtttaaagctcttcaactaaaattttagatgcatcttcagaccttatagcaattacggcacctcgtatcatatatgccacaggatcaccagaggggctttggcttagtgcagtgatttcagttccatagattaatccaaggtctaaaaatcttcttcgaatattaccttcagctgttaatgatgtaactttacatttttgtcctaatttaatatcagttaatgatgtgtctatagtttttttaataatagtgttcataattatctactccttaattttgtactagtttagcttagtgaaaatttttttctttagtctaacatatgaattatgattaaaaattgacacataaaaacaaaaaattcacataaatattatattggtggtgagtaaattatgaaaaaagatttccatactgtaagagggtatgagaatataaacttgaacaagaagctgcttacaccatctatggaagattatcttgaaatgatttatagatgttgtgaggaaaataaattcataagattaaataaactagcacaaaatcttaatgtacgtgattcgtcagcttcgaagatgatgaaaaagttaggggaacttgggatgataaaatatgagccttatggtgttataagtctgacagatgaagggagggttataggaagatatttattagacagacataatataatagctggatttttgaaaaacataggtgttaaagatgaaattcttgcagaaacagaactgatagagcatgtaataagtagcgatactgtggaaaaaatagacagactaaatgagtttttttctagtaatgaagagattgtagaaaaatttaagaagtttaaaaaaaattctaatgaaatataagaaaaatattaagtaggtaatagatttattagttatgaagaaattaaataagtttaaaaataatattttattaaaatgttattggactgattttaaattatgtactcaatataagatttaaaatgaattgtatgttatattatttttacatacaatttattttttttgcaacaatttatggttttgaattgtatattttatagaaaggggataatttaatggctgatatttcattgcgtacggatgaaattatctcacgtgatttagatgattatggcgatatgattttaagacttgcatattcatatatgaaaaatattcatgatgctgaagatatattgcaagatgtatttgtgcagcttatgaaaaatattgatatatttcaaggtaatgatcataagaaatcgtggcttattacagtaacaagaaatatgtgtaaaaataaacttaaatcatcatggtttaaaagtagagaagaattgatagaacttccatattacgatgaatacaagaatgatgatattattgaagctgtgatgaaattacccttaaagtatagagaagttatacatttattttattatgaagattattcgacagcacagatagctgaaatagttaataagaaggaatcaaccattcgttcattattacatagaggaagaaatatcctaaaaaaaatgcttaaggagggatatgattttgaggaataggtataaagatgagatgagtaagattcatgtagatgatgatatgaaaaagagagttatgaatagaattagagaaactgatgaagtagaaacgaaagtaaataaaaaatcactatttcaaggacaagcgttttttaaatatagcggagttgtcgcagcctgttgcgcatttgcagtaacatatgcagtaacaattaattatccagaactagtgaatcatgatgaatcatctcaaactgaaagtgaacatactttaaatagtgaagaaaaccaaagttcatcagagaaaaataatgatgtacctttagtaaaagaggacagtaataatatatcagatagtacaaaagaaaatagtgtgaaagaaaatagcacaaaaactgaaaataaggaatcagataataaaaaacaagataagaataaaacatatgaaaataataatgaaaaaagtttagatataaaaaccaatgaggttgcaccagagaaagaaaataaatcagatagtaatacaaacaaaaaagaagtaagcgataaggcgaatgaatctaataataatgtttctaaaaaagaagacgagccaaatagtataaataataatcaagctgtcagtagtagtgaattgcaaagtagtaatgataatgtaaataataacgaaatacatgatcctaataaaacaaaggcagcatcctatggaatgtcaatacaaaatgaatacttgtcacaatataatggaccaaatttaagtgatattggatataatgtggattatataaatcaaattgatgaaaatgaaattgaaataaaatattcaaataatgaagatgatttgtggataagaatatataataaagaagaaagtaattcagacaagagtagtgtatacgagaaacaaaaaatatcttcagacaattatggtgatggaaaagaagaagggataatttatagaaaaaataatagagaatattatatatggtccagtaaaaaacttgatgaaaactttattagtaatataacaaaacatattttataaatgatgcagagtatatgatatactctgttttatttataaatattaatagaatatgaaataaagcaataatatcaaaagaaaacatgtaaaaagtcacattagttgcaatatttgctgaaataataaaatgttaaaattattgtctttatgttatagtaaatatataaattttgatgaaaagggacaaaatttacaagttaagtttgtatataatacgggagggaagacaaaaaatgagaagacatagaaaagataatagtaaaaaggttgcaaaaatcatggtaatgtccctttgccctttaatagcaatgtatctgggaatatcagcttattttatgaatcatttttattttggttcaacgatatatgacgtgaatgtttcaggaaaaactgttaagcaggcagaagcattactggctgatgagatatctggatatacgctcaagttgcaaggtagaaatgatgtttcggaagaaattaaaggtacagatattgctttagaatatgagcaaggtgataagattgaaaatttcaaaaaaagtcaaaatccatttttatggatagcatcgttatttaccaaaaacgaacttacaaatgaacaattagttacatttgataaagatctactaaaagataagattgataattcttctttttttgataaagaaaatataatagaacctaaaaatccaacttttgaatatggggatgacggatttaatatagttactgaagttaaaggaagtaaaattgatgaggaagttttagttaataaggtttcagaagcggttaaagatggaaatacagttatagacttaaatgaattaggttgttatgtagaacctaaatatactgaaaattcgccagaagtaaacgaagctaaaaagtcattagacaaaattgcagattcaaagattacatatacatttggtagtagaagtgaggtcttagatggatcaacaataagcaaatggcttaatgttgatgataatatggaagttactgttgatgaaaatcatgcaagacagtatgttgaatcattagcacgaaattataatacttattctaatacaagagattttacaacatcaacaaataaaaaaatacaagtttcagggggaattatggctggataattaataaacctgaggaaacaaaacaattaattgaagttataaagcaaggcgaaaaagttacaagagagccagtttactctcaagaagccatatctagagaaaaagatgatgttggaaatacatatgttgaacttgatatgacaaagcaacatatatggttttataaaaatggagcattaatagtagaaggggatgttgttacaggaaatgcagccaataattggtctactccagttggaacataccgattgaattataaagagagaaatgccacattaaaaggtgaagattatgaatctaaagttaattattggttgccatttaataataatataggaattcatgatgctggatggagaacagaatttggaggacagatttatctgacaaatggttctcatggatgtgtaaatgcaccatatgaagtagctgaaaagatattccaaaatattgaagcaggaacgccaattatttgctattacgaatagaataattactgaaaaaatcacaagaactaatttagtataatagttcttgtgatttttttatttttatgtatgttttcattagtaaataggaatgtcttttatgaattatgtttgaaacagaaatttcagaatgatgactatataaatgattagaaattttgttaatgtagaattaaagaaatttgaatggttaaaataatagtactaattaaatattattgcaagaggtgttgttatatgagtgaaaataaaaatacattaaatgtaagtagtgttacaagtggaattccagatatgaaagtaaattcaaataatacagatgttacatacagtaatccacaaattagttatgatagttcaaataataaaagtgatggtatgattggaaatatgccagtaaacattaataaagatgtgcctacaccaaattctgatgcgcagaatataacttctttaattaaacattctggagaggttacaggatatatattagaagatggaacacgtttatctaaagatgaaggtgttactttagcaaaaagtggaggcataaatggagtagcagtaggagtatctaaaaaaggcgaagaatatttaagaagtcttccagatcagaatgaaaataataatttaagttctctaccaacagtaaatgaatagaaaaaaataatatattgatatataaaaagagataaagttataatttgaacagtataatgattaattatagttagttcaaagtgtatactttatctcttttattaaaatatagataaatatattaataatgtacgtgaacaagccagaaagttatttttttatcactccatcctaaatcccaaggtacattatttcgatcagtattatgacatgtgacaagggaataaccttttgaatctgcacctgttacaacagaaatatgtgttatgtctccctttttttcatatgcaacaaagtcaccaggaagaagtttataagaagctttatatactttttcataatttccttttgcaattacagatgctctgccactgttaagcatataataagtaaatttatctgcatttacccaaggtccagttacgtctcctttatcataattccatgctgatgtttctttgaattttccaccttcatggagaatttgagatgcaaaattagcacaatcaccgccctcacagttgaaatttttatagtctttattatatttatattcgtattcttccagtgttgcagcaccacagtatttcatagcataatcaatagaagctaaacgcctttcacctattccactcatatctctaggcggttgagaacttataaattctttaatcttgtctgctttaatattctctagacttagagaatcagcaaatggatctgtataccattcttttgttattatatattcatcattttccttagaaagttgcatggaatgatatgtgccgattctagagctattcactttgctttcatcatctggatatatatatttatattcagtgttacacattatgtataaagaatatttatctttgttttttgaaggaactatttttttgattattatatttggaattatatcaataaatttgacaccttgtttttctgcccagttatttatatatttaatctttttttgttcatattcatatgcccactgaccaaattttatatcagtattatataatgcctgaatagaatcaagatcctgggttaatatagccttattgcgtattaaaaatatattttcaacgtgtgattttacatcatcgttctcatctgcaaatgttactgatggattaaataaaatataaaatatactgaaaaaaatacataaaatagagatgaatttctttaaaataattatgtgacagtttttatattgcaacatttcagcacctcttttcaaattatggtattttactgtcgattaagctaatacattctttaacataactatcttcagaaggaaccccagcgaaccaattattatcattatcgtgttgagaaaaatatcgagctttaagaattatttctggtctgtattcaaagtgtaaaatatcaaaatatccccattttccaccccatacaaagttattcttttcgaatgcacttacaagttcttctggatattcacgaattcgtgattcgccttgttccttggaagcccatttccagtaatcacgcttatcactttttaaatcaattgtaattccataagcatggggacttaatctaccagttcctgaaattactctataattatatgtaccacttgcaggataaagtatggcggctattttatcattgtttttagatagaggtacaagttcccttaatgtattttctaaagcaatattagcgttattttgtttgttgaattgataatttgtgtatccgtactttaatgaacataaattcttttcaactgaactttttgaggaaccatagacttcatttaataatccatagtgtcttattcttccaggattaaaatctttgctcataatttcatttgttttgtttaaaggataaatatcttctaacatatcttgaaggtcaggatttgacaatttttcttcataacttttatttttcttatcatcatatataaactttgcaccactcttcataacgatatatacattatcattttcacataatatatcttgtatatattgaggataagcaatcattaatattaataaatcctgtttcattacggttttataatcagaatttatattatcctcattatataaagaagatgtaaaagttttgtcaaaactgactgaatatgatgggactacggaagaattcattattgtaaaactacacaataaaataagtaatattttctttatcatatgctacacacctttaataaaaataattataagaattatttctatttttcccaacagatgtggatactatgtagaatagaaagttaaatgttccttttattattttgatatattggaaaatttatatgttatttcatataagttaatttaaagaatacgaatacaaaaaaataaattttaaaaaatgtaattttgataccaaattgacacaaaagagttgtatagtattatatagagggaggtgagaagataatgggtaatataataaaaataaatatgtatgttgaaaacaaaagtaaaagaaataataagcttgaattaaaaaatgtagaagaagatatcttaaagtacaatgattggttaagaagaactaacagagaggataagattgaaaactatgaaaagtttttacaagcaagatagtccaaattcaaattagaggtaaattaaatgaatttatttaatttacctctaatttttttatataaattcttattaaattctgaaaaaaatttgattttttttgataatttaatacaatataataaagaatagtttttgtagatttatattatagagttctatatttagttttgtaaaaggacatgaaaaaaaattattataagctgataggagatgaatatgactaaaattagaaaaagagatacatttaatagtaaacttggatttacgattgcgtgcataggatcagcagttggaatgggaaacatatggctttttccgtatagaacaggtcaatttggtggtgcagcatttttaataccatattttttatttgtaattatcattggcattgctggtgtaacaggagaaatggcatttggaagagctatggagtctggtcccataggggcatttagaaaagcaacagaatcacgtggaagtaaaattggagaattgattggacttattccaacacttggatcgttagcaattgctattgggtattctgttgtagttggatggatcttgaagtttacagtaggttcaattacaggttcattaattaaaagtaattctggagaatattttaacgagctatgtggaaaatttggaagtgttccatggcatatgtttggattgtttttagtatttatctttatgatattaggaatagcaaatggaattgaaaaagttaataagattattatgcctatattctttatgctatttatagttttggcagttagagtaggttttttagaaggttcagataaaggttatcaatatttgtttaaaccagattggaatgcattaaaggacataaaaacatgggtatatgctttaggacaagcatttttttcactatcaatcgcagggtcaggaactcttgtttatggaagttacttaaaaaagacagaagatgtagtatcgtgtgcaaggaatgtggctgtgtttgatacaattgcagcaatgcttgcagcccttgttattattccagcagtatttgcatttggtcttgatccatcagctgggccagcccttatgtttattaccatgcctaaagtatttcaaatgatgccatttggaaatctgtttatgattctattctttttagcagttttatttgcggctgtttcttctctagtaaatttgtttgaagcacctatagagtctattcaagaaagatttggagtatcaagaaagatttcagtaggaataattgcagttattgcaattattgtaggtataatgattgaagatggagatacagtaagtaattggatggatatagtatcaatatacataattccactaggagcattacttgcagcagttatgtttttctgggtatgcccaaaaggatttgcaaaagatcaagttcaaattggacacaataaaccaataggaaaatggtttgaaccactaacaaaatatgtatttgttggattaacaataatagtttatattctaggaatattttatggtggcataggataattaaaaaagttataaatataagcaatacttagtatatgaaaagattagtaagtaactataattagttactttataaataaaggagtggcagtaatgatatcaaaaaaaatgtatgaactaggaagtaaaaagtcaacaataagatcaatatttgaatatggtagggcaagagcaaaagtagttggagaagagaatatctatgattttagcttaggaaatccaaatgttccaactccaaagtttattacagaaacaatgatagatatattacaaaatgaagatccttgcagtatacatggatatacagttgcacaaggtgatcctgagtgtagagaacttttagctaaaagccttaataaaagatttggaacaaactttactggaaaaaatttatttatgactgcaggtgccgcggcatcaataactatatgttttaaagcattatcagaagaaaatgatgaatttataacttttgcaccctattttccagaatacaagtgcttcgttgaatcaacaggagcagagttaaaagttgtaccagcaaaagtagatgattttcaaattaattttccggaatttgaaaagatgataaataagaatacaaaagggattatagtaaattcacctaataacccaagtggggcagtatattcagaagaaacaattataaaacttacaaatttattaagagaaaaagaaaaggaatatggtcatccaatttttctaatagccgatgaaccatatagagaagttgcatataataatgttcttataccatatcttcctaaatattatgataacactttagtttgttattcatatagtaaatcattttcacttccaggagaaagaataggctatattgtaattccagatgaaattgtagattttaatatgatatctgcaagtattggaggcgctgcaagagtgttaactcatgtaaatgcacctgcattattccaaaaagtagttgcaagatgtgcagatatgccttctgatataagtgtttatgagaaaaataaagaattgctatataatggattaattgaagctggatttgaatgtactaatccaggtggtgctttttatcttttcccaaaagcattagaagatgatgaagtagcattctgtgaaagagctaaaaagtatgatttattattagttcccggaggggactttggatgtccaggatattttagagcatcatactgcattagtacagaaacaattaagaaatcattgcctttatttaaaaaattggcagaagaatataaaaaataggctatttatatagttaattgaatttataattgtgatatgttattaaaatatttaatttattatcacaattttgaaaaaagagtataatattaacaaaacttaaatataaatccacttgaataattttaaaatatagaatagaatagtttgcataggaactaaaaagtatctatgcaaactattttttttattctttaggaaattatattgcagtgaaatctgtgaataactttgtaatattaaaaacgtgtattaataaattaagagttctaaagaataaaaaatgattgtagcccgcaaaagaatccaaaagcaagttttggaaccttttgcatgggtgaaaaaaatcgacggctaaagaattaattttattaaaaaattaattttattaaagctaactttttagtatatgggatataacatagtctccttggcaatttttttattataaataattattgagagaaggaaatataaatgaaagaagagtcttttgagatatcaatgctcataaaagaaatttactcagatacaatggctgtagtgagtaaaagtttaaaaggaagtggattaacaaatcagcaaataatggtgataaaacttattgctcataataaaaaagttaatatatctcagctttgtagtgaaatgtctttagcaaagggcactgtatcaggaatagtttctagaatggaaaaagcgggttatgtaaagaaagttaaggatgagcatgacaatagaaatacatatgttacattttcagacaagggaattgaatttgcaaaagaattcagaaaagaaataaacagcagttttgataaagtttttgaaaattttacttatgatgagattaaagagataaaaaatagtttgattaaattaagagatgggataaaggagactaaataaaatgaatggaaaattaatttttgcaataatatttataacagctgctcttgtgttttacactataggagtatttagtgaaagaagagctaaaagtcttaataaaaatcatgttttgtttttttggctaggtcttttatgtgattctacaggaacatttttaatgggacaaatagcgaaaaatcaagtagtgataagtaaaagtgctggaatgatacatggaataactggatttgcagctattgtacttatgatattccatgcagtatgggctacttatgtattgaagaaaaatgatgatgataaaaagagagatttccataaatttagtataatagtatggttgatatggcttataccatatgtaataggaatggttattggaatgtcaaagtaaattatagataataaaaagacactctactgaatgagcagccagcttttctgctaaacagcagatagttgacaattctagacagtagggtgtttttttataaaataatatgaaatatagactaggaaattatttgagtttataattttaataaagaaaatttagcaataattggggatgtattatggataatatggataatatgatattacagtgtttaaagaaaaattcaagagtaaaagcgtcagagataagtaaagagatacatttatcagtttctgctgttcttgaacgaattcataaaatggagaagaacggagtaataaaaaattttactatagttgtagatgaagcaaaactggggaatgaaacaagtgctcttatggaggtaagtttagatcacccaaaatattatgattcatttacagatgcaattagagcaaataagaatatagttttttgctattatctcacaggtgatttcgattttatgattaaaattttatgcaagtcatcagccgaattagaaaaaatacacagagaaattaaatgtcttggaggtgtttcgggaactaagacacactttattctaaaaaatgtaaaagagggattctagaataaaaatattcactgtagattgtaataaaaaatttagtataacgaaaaaattccataatacaatgtaaaatacagaaaaaattttggatttatatattataaaaaataaataatttctaaatttaattatttattgaaaatattagaatcgtgatgtaagatgtattcataaataaaaaaagatataaaaacacgtatagttaggcaatggtgtcaaaaatgtattgtctaataaatgcgtgttttttttgtttaataagttgtattgtataggaggaattaagaatgaaaaatttaggttattacaatggagagtatgatttaattgagaatatgaaagttcctatgaatgatagggtatgttactttggggatggtgtatatgatgcaacatatagcagaaatcacaagatatttgctctagatgaacatattgatagattttttaatagtgcaggtttattgcagatgaaaattccttatacaaagagtgagcttaaagaattactttgtgatatggttaagaaagttgattgtggagaacaatttgtatattggcagataacaagaggaacagaaatgagaaatcacgcttttcccaaaggtgatgctaaggctaatttatggataattttgaaaccattaaatataaaagatatgtcacataaattaaaattaataacacttgaagatacaagatttttgcattgcaatataaaaactttaaatttgttaccaagtgtaatggcagcgcagaaaactgaagaaatgggatgtgatgaagctgtatttcatagaggtgaaagagtaactgaatgtgcacacagcaatgtttcaataatcaaagatggtattttaaaaactgcaccaacagataatttaattcttcctggattgctagggcacatttaataaaaatgtgtaagagatttaatattcctgtagatgaaacaccatttaatttgaatgagcttatgaatgctgatgaagtaattgttacaagttcaggacaattctgtatggcagcgtgtgaaattgatggaaaatctgttggaggaaaggctcctgaaattattaaaaaattacaagattcacttcttgaagaatttttaaatgagacagatattgaagaatatagtgtttgttaaaaggaggaacaatcatgaatcaagaagaacttacaatttttaatattggagaaaatttagatagtttaatgaatttagatccacgaggatatggtgtatgcagaattttatatagtgcagcaagggaatatactggagaacccctttcaactaatagtgcaaagaaacttgttgatacattaaaagatggggatatggtttatataatgacaggttttgtattgagaccatttaagaaagctgaaatggatggaattgtaagtacaatgcttttagcaagggccttagtaaagggatttggagttaagccagtaataatatgcccaaaagataacatagaagcggtaaaaaacttagcatatgctgtgggggtacattttcatgatacaattgaaggattatatgaatatccattatcaatagcagcaattgaatttactaaggattcagaaagagctgaatatcaagctgaagaattaattaaaaaaggagtgccatcagctgttataagtattgagtgtccaggagctaattcaaaaggtgtatatcacaatgcggttggtcttgatgtaactgaacttgaggcaaaacaagatgtgctatttaataaacttaaagaaagaggagttttaaatattgctataggtgatcttggaaatgaaataggtatgggaacacttaaggagcagttagatgaatatattccatatgcagccaaaggaagatgtaagtgtggatgtaatggtggtatagcagcaagtgtacaggccgataatattataacagcaacagtttcagactggggatgctatggacttattgcagcattagcttatttaaaggatgacttaaatattatgcatacaaaagaaatggaagaagaggtaattaaaacagcttcaagaagtggaatgatagatatgtatggagatttgattccagcaatagatggatgctgcatggaaatgaatacttcaatagtaagtttgatgagagaaaccataaaatcagcgatggagcttagaaagacttgtgcaacatggtttgaaaaagtaattgaactaggattttatgaagagcagattaatgaagtatatgaaaataaaaagataatataaggagatgagcaaatggactgttcaaaaatgaatccttatgaagttagaagactaataagaaatgaagagataattgaaccaacagcaggaatgtgtgctgggtatgcacaagctaatcttgtaatattacctaaagaattagcttatgattttttgttatttactcaaagaaatcaaaagtcatgtccaatacttgaagttggtgatgtgggcgataaaatgatgaaatttttaggggaagatattgatataacaacagatatacctaagtatagagtttatgaagacggtataatgacaggagaatacacaaatataaaagatttttggaaagatgactttgtaagttttcttataggttgcagtttttcttttgaatctgatcttttagaagaaaatattacaataaggcatatagaagaaaaatgtaatgtaccaatgtatataacaaatattgattgtgttccagcagggatttttaatggtaaaatggtcgtaagtatgagacctcttccatatggtgagattgtaaagtctgttcttataagtggaagtatgcctaaggttcatggagcaccagtacacattggagatccagctgtaattggaataaaagatatagataaaccgcattttggtgataaggttacaataaaggaaggagaagtgccggtgttttggccatgtggtgttacacctcaggcagtagtcatgaatgtaaaacctaaaatagtaataacacatgcaccaggacatatgcttataacagatataaaaaatagtagtttaaagtattaaaaattattttatatatttataatcaggagaagaaaagtatgtatagagtagatttaaactgtgatttgggggaaagttttggcaattataagataggatgtgatgatgagattattccatatatttcatcagcaaatattgcatgtggattccatgcttcagatccattagttatggacaagactgtaaaattagcaaaggaatatgaagtgtcagtaggtgcacatccaggattatctgatttagcagggtttggaagaagaaatatgaatgtttcatgtttggaagtgaagactatggttcaatatcaaataggagcattaaatgcattttgtattgctcataaagtacaaatgaagcatgtaaagcctcatggtgcactttataatatggcaggtaataatttggatttggcacttgcaatatgtgatggcataaaatctattagttcagatttaattttgttaggattaagtggaagtaagttgttagaagcggctaagataattggattaagatctgctagtgaggtttttgcagacagggcttataatgatgatggatcgttagtttcaagaaatattgagggtgcagtaatagtggatgaaaatgaagctataaatcgtgttgtaagaatgataaaagaaagaaaagttgaaactataaatggaatagatatacctataaatgcagaatcaatatgtgtacatggagatggtgtaaggtcacttgaatttgtaaaaaaaataaataatgttttcaaaaatgaaaatatagaaataacggaattgagtaatattgtataatgaatcaacaaaaataaataattttaaaatgtaatctatgattgcagggcaatggagtctaaatttgttctgtagttatggatttttttattatattaaaaaggatttacctttaatttagataggagggataaatcatggaagaattaaattttgatatagtacaggttagtgaaaattgtgcattaattgaatttggaaataaaataagtgaagatataaataaaaggataagaatattttgtgaataccttgatatgaaatcattttatggaattatagagtatataccttacttttctagtgtatcactgatttatgatccattaaaaataaaaggtaaagaatcatttgattttgtaaagaaaaaattagaaagcatactattgaatattgatttttcacatgattataaagaaaatgtggtggaaatacctgtatattatggaggggaatgtgggccagatatagagcatgttgcaaaagtgaataatattactgtagatgatgtaataaaaattcactcggataaaaggtatctagtatatatgataggattcgcacctggatttccatatttaggtggattgtcagagaagttatgcactccgagaaaaagtactccaaggctagttataccacaaggatcagttggaattgcaggaatgcaaacaggcgtttatcctatagaaacacctggaggatggcagataattggacaaacacctattaagttatttgattttagtaaagaaaataaaacactattaaagtgtggcgatatagcaaaattttatccaatttcttatgatgagtatcttaaaataaaggagaaaatatcatgagtataagtattttgaaagcaggtcttttaactacaatacaagacaaaggacgatatggatatcaaaaatatggtgtggttgtaagtggcgcaatggacagtttttctatgagattatcaaatataattgttggaaatgatgaaaatgaagcagtgtttgaagttacattaatgggaccagagctaaaaataaaaaagggaaatttaatatcaataacaggagcagatctttctccaactataaatggaattaaagttcccatgggaagaccaatatatttgaatgatgattgtatagtgaaatttggagcatgtatcgatggatgtagagcttatttatcaatagctggtggatttgatataccacttgttatggaaagtaaaagtacatacataagaggaggaataggcggaaaagatggaagagcattaaaaaatggtgatgagattaagattgctgaaaaaaatgacttatctaaaaaaataataatgaaattatttgatagtaaaagtaaaaaagcatttacttatccaaaatggtatataaaagaggctatatttaaaaagttagaaaataatgaaataagagttttagaagacaggcagtttaaagatgtgtcatatgaaagtatagataaattttttgatttggaatttgtaatagatagtaaatctgacagaatgggatatagattaaatggcccagaaataaaatttaaacatgatatagaaatgatatcaggagaagtatcctttgggacaattcaaatacctccagatggaaatccaataattttattggctgatagagcaactgctggagggtatccaaagatagctcgtgttatatattatgatttccaaagaattgttcagcgtaagccttctgaaaagattaaatttaaaagaataacaattgaaaaagcggaagatctttatttagagagagagaaatatattgaagacttaaaaaagtctataaaactaataagcatataggtggtgaatttaaaatgatacaaatagaagatttagaaaaaataattaaaatagttgaaaaacatgatatatcacattttgagtttgaacaaaatgatagcagagtagttattgaaaagcaatcattaaaacctgtatttaataataaggctaataatagtgagattaaggttattaatgaatacataaatggcaaagaagataacctattcactaatcatgaaaaaatagataaaaattatataaaatcaaatcttgcaggaacattttatttaagaaaagaagaaaattcagaaccatttgtagggcttaatgaaaaaataaatgaaaacactgtagtaggactggttgaagttatgaaattatttaatgaggtagaagctggagtaagtggtgaaataatagatatattggttgaagatggagattttgtagaatatggacaacctttgtttgaaataaagatttcttaaaattcataaaagcataatagaaacataataggcggtgataaaatgttcaaaaagatacttatagctaatagaggagaaattgcagttagaataattcgagcatgcaatgaacttgggatttctacagttgcagtatattcagaagctgataaaaattcactacatgtaaaactggcagatgaagcatactgcattggaaaatcatctcctaaagatacttatttaaacataaataatataattaatattgcagttcatacaaaagcagaagctatacatccgggatatggatttctttcggaaaatacaagttttgcaaaattttgtgaagaatttaatatatgtttcataggtccacattatactataatagaaaaattaggggataagtctaatgcaaaggaaaccatgaaggaagcgagtgtacctattgttccaggtagtgatggtgaaattaaaagtgttgatgaatctataaaaattgctgagaaaataggatatcctgttatagttaaagcatcagctggaggcggaggaaaaggaatgagagttgcagaaaataaaggtgagcttataagtgcaataagggaatgtgaaaaagaagctgatagttattttggaaactctgctgtttatcttgaaaagtacttaaatcatacgaggcatgttgaaatacaaataataggtgataattacggaaatgtagtttatttaggggaaagagactgtacaattcaaagacgtcatcaaaaacttgttgaggagtcaccatcaccagcacttgatgaaaatttaagaaagagaatgggagaggcagcagtcaatgcatcaaaagcttttaaatataatagtgtgggaactgtagaatttttattaaatgaagataataatttttatttcatggaaatgaatacgaggatacaggttgaacatggcgtaactgaaatggttacaggtatagatttaataaaagaacagatactggtctcttatggaaagaagttatctttttcacaagatgatataaaagtcaatggatgtgcaattgaatgcagaataaatgcagaagatccttacaataattttatgccatgtccagggaaaattgatgaatatatagcttcgggtgggattggaataagagttgatagtgcagtgtacagtggatatgttatcccgccattttatgattcaatgatattaaaattagtatcatggggaaggaatagagaagaagctattgaaaggatgaaaagagcacttgatgaatttattatatctggagtaagtacaacgataccttttcatagaagactcatggataataaaatttttagaagtggggattttaatacaggatttttagaagattataaaattttagaagagtatttatataataatgattaatttattgctaatcattatttttttatgaatatagaaaaaagaacctaaaactggaaaataaactgtattgatacaatgtatatatttattataatttggaggggaaataatgataaaaagaaaaagattattgataagtattatgattgcaggtatatgttcaagtatatttaccaatgtaaaagtatttgcatcagataaatcaaataagggattttatattgaaaatggagtacttaaaagtatagatgaagatatatctggtgaagtagatattccatcagatgtgactgaaataagtgaacagctgttttttaataatgataaaataactaaagttgttataccaggttcagtgaaaaaaataagtaacatgtcatttaatggttgtgaaaacttaacggaagtaattattgaagaaggagtagagtcaattgggggagactgctttacagggtgtgataatttagagaaagtaactattccgtcaactgtaaaaaaaatagataccaattcatttggtttatgtggaaaattaactgatgttgattttaaaggtgattcactacaaatagggagatgggcatttacaaatacaccatggcttgaaaaacaaagaaataatgatggattagccataataggtaatgttttattagatggaagtaaagctagcggctcagttgaaataccagcaaaagtaacaattattgaagatggagcatttgaaagaaataataatatagagaaaattattttaagtaataaacttaaggaaattggccagtacgcattttatggatgcgagaatctatcaagcatacaattaccggaaagtttaaaatctataggatcaagtgcttttgatggatgtaaaaagatttcagatatatatattccttatagtgtgagtcagattggaactaatgtgtttgatgagaatactaatttaactggtaatactgaagtatactataaagtacaggaacaggttaagcatgaattgcagtattctattccatcacttactatgtttagagcacaagctggatggaatagttataatggtaataggttttacaagaaacctgatggaagcatacagactggatggatgagtttaaatggaaggctttattacttttatagcaatggaatacaggcaacaggttttataaatcttaatggtacgtattattatttagatccacagggttcaggagatgattttggaagtttaaaaactgggtggcaatctattaatggaaattggtattattttaatccacagagtgaaggcgataaagcacagggatttatgaagacatcttggttctgcaataatggaaactggtattatttctatagtgatggaacaatggcaactggatttattgatttaaatgaggcttattattatctagatgaaagtaatacttcaaatataggaataatgaagtcaggatggcaaaaaataaatggatattggtattatttcaatacaataaatgatgatggtgttgcaggaatgatgagaaaaggatggaagaaaataaatggagtttggtactattttaattattcagatggtaaaatggcatcaaatacatgggttgatggttattatgtaaatgaaaatggagctttggaacagtagaatataagtttttagatgtattgaatttatttagtacatcttttttagttggaaaaataatttttagaaattctgatcatttaataaataataaaaagttaattatttggaattataatagagtgtatagtaattatatcaaagtaatttaaggagaagtttatgaagattttaatggatatgtttattacattttttaaaataggtgcatttactttagggggcggatatgcaatgcttccaataatccaaaaagaagttgttgaaaagaaaaaatggataggtgaaacggaatttcttgatatggtagctatttctcaatcagctcccggaccattagcagttaatataagtgcttttgtaggacaaaaaatgaaaggtttagttggtcttataacatcaacattaggtgcaatattgccatcgtttataataataattttagttgcatcagtatttttaggaatagaaaatagtcctgttgttcaaagagtgtttcaaggaataagaccagctgtagtggctctaatagcagtacctgtaataagtatggggaaaactgcaaaagttaataagaaaaattttataattcctcttttagcagcagttttggttgctatatttaagattacacctatatatgtaattttgggtgctgcagctataggggttatagatgttttaaggagaaaataatatgttaatcagattattctttacattctttaaaattggattatttagttttggtggaggatatgcaatgcttcctctaattaagcaggaagtagttgatattaatagatggatgtcaaatgaaagttttactaatattataggaataagtcaggtgactccaggacccttagcgattaatacagccacctatgtaggatataaaacaagtggaataattggttctgtatatgccacattaggagtaagtttaccttctataataataatatttataatagcaaagctttttatgaagaaaaaaaataataaatatgcagaaggaattttaaaatacataagattgtgtgcagttggtttaattgcagcagcagcaattatgcttatggatgatgttacagcaaattttagaagctttattatctttctttcagcatttgtacttagttataaatttaagatggatcctatacttttggcggtattgtctggaatcgtaggatttatagtgttctaataattaaattactttatgataggggatattcaaaatgaacaatattgtaattgttggaggtgggataggaggattatgcagtgctgtaagacttcttagcaaaggatttaaagttacgatactagaaaaagagccaacagtaggaggcaaagtcaatagaaaagaaattaaggattttaattttgatcttacagcaagtattttgatgacacctaaagtatatactgatatttttgaagatttaggtaaaaattataaagattattttgaaatgataagattagagccaatatataatgtcttctatgcagataatacccaatatagtttctatagagacttaaaaaaaacaaatgatgttcttgaaagtattgaaagtggactttctcaagagtatgaagaatttttttataaaaccatgaaaaaatatttgattgctaataataattttctttgcaagccaatgctaaacatgaaagaaatactcaatgtaaattcaataaaatcagcactacagatggatgttcttgaaaattcaaataaatatttatctagtatgattcataatagaaaattaaacgagtatttaatttttcaagctatgtatatgggggtaaatccatataagaatacaaacctttatacaatgattccagcaatatctcatgcttatggactttcatatataaagggaggtctttatcaatatatatgtgcattacaaaagttaatttatgaagaaggcgggcaaatagaaacaaatagtcaggtaaaagaaattgtaataaaaaataataaagttgcaggtgtaagaactaaaaaattattttatgaggcagattgtgttgtatgcaatgctgattatccttatgcagttaagaaattgattccaggatacagcttaggtatgagttacacaaacagttgtattgataaaaaggaatattcatgttccgtctttatgatttatttaggacttaataaaaaatatgatgtattaaatgtccataatatttatataagtaaggattttaaaaaatctatagaagatccttttaatggaaccctttcaaaaaatccatcaatttatatgtactatcctagtgctgtagatgaaagtttatgtagcaaatcaaaatcagttcttaatattatggttagggtaccaaatttatcttttgaaactgtcaaatggacgagaaaagatattatgaattatagaaatgtaataataaaacatatatctgatataaaaggcctagaagatatagaaaagcatattgaatgtgaagattatcttataccagatgaccttgataaaaagtttaatgcatttaagggaaatgcttttggtttaagtcataagcttagtcaggacatatatttaagaccgcatataaaatctgaaaaaattaaaggattatatttcattggttcatctacacatccaggaaatggtgtatctataataataaatggaacaaaggttttagctgatattatttgtgaagacttcagatgaatttatatttaaaaataatattattttcaaatataaattttactgatataatatatctatattatcaaataataattactatttgataataatatattcatttaaaagctttagtatccacacatctaatgaaaatataaaataaagtgtaaaaatatacgaagaggtaaatatacatattgtaatgtatacgaaatagaattcataaataataaaggagtgatttatatgaacataacttttaaaggtaaaaatgttactattggagataatgatgtaagagttggagatatggctccagaatttaatcttactaataataatttggcaaatgtaactttaaatgatacaaaaggaaagagaatatttgttgtagttccatcagttgatacgcctgtatgtgatagagaaataagaaaatttaatgaagaagcatcttcgttagatggtgttcatatttatgttatatctatggatttgccatttgcacaaattagatggtgtggagcagctggagtagataaggttacaacattatcagattataagaatagagattttggacgaaattatggaacatatataaaagaagttggattactagcaagatcaatatttgtaatagatgaaaataataaggttacatacgttgaatactgtagtgaagtttcaagtgatccagactataatgctgcattaaatgcagcaaaaaatctttaaggagaagtgtgtgagtagagtagatgaacttagatcattaataagattttatgaagagcagctaggtgaagatgagggcgatttatatgaagaatatgaaatagaacttgttgcagctatagatgaattgaataaactaacaaagaattctaatgtagaataatattaaaaatatagattagattcaataaattttagaaaacataatcatgtcaaaataacataatattttatcaatattgtataagaaatctcccctaaaagtatatatactagaagtatattgaggggaggtttttttatgaaaaaagaatggtggcatgataaggtagcatatcagatttatccaaaaagttttaaggatactaatggagatggtataggagatataagaggtattattgaaaagttagattatttaaaggatttaggaatagatattatatggatttcacctatgtataaatcaccttttgtggatcaaggttatgatatttcagattattacagtattgcacctgaatttggaacaatggaagattttgatgaacttttagaagaagctaaaaagagaaatataaatattttaatggatcttgttataaaccattgttcagataagcatgaatggtttcaaaaagcactaaaagatccttacggtgaatatgcagaatatttctattttgaaaaaggaaagaatggtaatccgccaagtaattatagatcttactttggaggaagtgcatgggagccaatagaaggaacagatttatattatcttcatttatttgcaaaagaacaaccagatcttaactggaataacgaaaaagttaagaaagaattatttgaaatgataaactggtggcttgataagggacttgcaggctttagaattgatgcgattatgaatattaagaaagatacaagttttccagattatgagccagacggtgaagatggacttgtaaatgcagctaaaatggtagaggaagtagaaggaataggagaaatgcttgaagagcttaagggtgaaacttttgaaaagtataatgcttttactgttgctgaagtatttaataataaagaagaagaactcgaagaatttataggtgaaaatggacatttttcaaccatgtttgatttttcagctgaagtactaaatcatggtgaccatggatggtatgatgctaaaaaaattgaatttgattcgtggaggaatactatatttgaatcacaaagaaaatctattggtaaaggatttctagctaatattattgaaaatcatgatgaacctagaggggcatcacgatatcttccagattacgcacagaatgatgagggagtaaaaatgcttgcaactgtaagtatattattaagaggaatcccttttatttatcagggacaggaaattggaatgagaaattgtccaatggatagtatagatgaatatgatgatattcatactaaggatcaatatgagatggcattaaagactgggttgaatgaagaagaagcgcttaaggtatgttataaaaaaagcagagataattcaagaactcctatgcaatggaataatttattgaatgcaggatttacagatggaaatccatggcttaaagtaaatcctaattatatagatataaatgttgaaaaacagaaacaagacgacaattctattttaaattattatagaaatcttatagcacttagaaaatgtaaagaatataaggaaatattcacttatggtgattttgaaccagaatatttagataaagaaaatattttttcatattatagaaaaaataatgataaatctatattgattgttgctaattttgggaaagcagattcaacgttaaagctaaaaaataatacaggtaaattattattatctaatgtgagaaataaagaaatttgtgatggaagtattaatcttaaatcttgtgaagtagctattattttatttgatgataactcgaatatttaaggtttatgaaagtaataaagagtatatttaagatagatgtgaaaattaatttctgaatgcatgagtatttataaaagcataaacaatagtttaaaatatgtattgtattggtttaataaaaaaataaaattaaaacaaaaagattaaaaaagtaagagggatataacatgaatcaaaaagaaagaatgttaaacggacttccatataaagcgtggttagatggactttcggaagaaagaatggaaacaaaacttaaagtatatgattacaatttatgcagacctgataacaaggaagaaatgaaaaaaattattaaaagcataataggaaaaactggggaagaaattcatattgaacagccatttcgttgtgattatggaagtaatatagaagttggagaaaatttctattcaaattataactgcataatgcttgatgttggtaaaataactatagggaaaaatgtaatgtttgcacctaatgtatctatatatacagctggccatccaatacatccacaatcaagaaactctggatatgagtacggaattccagtaacaattggtgataatgtatgggttgggggaagtgttgtaattaatccaggtgttactattggaaataatgtggtgattggttctgggagtgttgttacaaaagacatacctgataatgttatagcagtaggaaatccatgcagagttattcgtgaaattactgaagaagatagaaaatattattataaaaataatgaatttgatgtagatgattacaaataaaataatatagttattttaataaaagcaaacctaaagtattcataataaatatttggtttgctttttattatataaaaataataagttttacaataatttaacgtaaataaccatttaaattaatattgtacaaatatagtgttctatagatatgattaaattgattttatttgaaagatttaggaggaatttatattttgggaaaagctatatgttttaagcttgccagtaagcaatatgatgagtttattgatgttattaatacaaaaaatataagaactgtatttcaaccaatagtatctcttgaggatttgagtgttatggggtatgaagcattaagtaggggaccagaaaatacagaaatgcaaaatccagaactacttttaaagtgtgcagaagaatgtgataaatcttttgaattagaatggctttttatatgtaaggcactagagaattcatgtcataaaaaattaaatacaaagctatttttaaatattgatcctgctattataagcagtataaaatttagaaatttatttaatgataaatgtttgcaaaaatatggagtagattttgaaaatataatttttgaaataactgaaagaaatgatataaaaaatatgaatcgttttaaagatgctattaacttttataacagtaaaaatagtaaaatagctatggatgatgtaggttctgggtattcaggattgaatttattatgtaatataaaaccacaatatttaaaattagataatcagcttattcgcaatattgataaagataagacaaaacaggcattggttacaagtatgtatgacttttctaaagttacaaattctattttgatcgcagaaggaatagaaactgaagatgaacttagaactcttattaatataggtataaaatatggacagggatattttatacagagaccaagtgaagaaatattagaaatatcagataatataagacaaataatagatgatatcaatattgttaaaaagaaaaaatatataaataatataaccaatgtatatattaaggatatcgctaaaagtaaaatatatataagtccaaacatgccagtatcaagtgtcgatttactatttaaaaagaacaaggacatatttggattatgtgtagtagaggataatgtggtaaaaggaacaataacaagaaatgcattatatagcagattaggttggcagtatggatatagtatttattattcaaaaccaatatctacaataatggaaacagattttttgagtgtggattataaaatgtctattgaaagagtaataaaatttgcaatgacaagagcaaaggaaaatatttatgatcatgttacagtaacaaaagattcaaaatattatggaatagttacaataaaagatttaatagaaaaaactacagaaatagaagttaataatgcaagatattcaaatcctcttacaggtcttccaggaaattttctgatagaaaaagaaatagaaaaatgcatatcacattatgaagagtattgtgtactatattttgatattgataacttcaaagcatataatgatgtttatggatttgaaaatggtgataggataataaaattattatctgacataataaatagaaatatatcaaatagaaattttataggtcatataggaggagatgactttatttcaataatatattcaggagatataaacaatatatgtgaatctataataaaagaatttgatgaattaaaattagtatattatgatgaaaaagatttaaaaagaggatacatagaagcacaaaacagacatggaatagaagaaaagtttccgttagtatcaatatctattgcaggaataactaaaaaagaagtgacgtttgatagtgtttatttacttgcaaaagaagctagtcagataaaaaagaaatgcaaacaaattaatggtagctgttatattattgttaaaatgtaaagctatcttattgaattatatatatgtttgtattataattttcattaaacaaaggagttaagataattaagtttaattatcttgctcctttgtttttttgccttaaaagatttattttatgaaaggagattaaaaaatggtattagtaagatcaattataagacctgaaaaggttgaaaatgtactaaaagcagtaagtaaagcaggattcaatgcagtgactaagatggatgtatatgggagaggtaagcagaaaggactacagataggatcagttttttatgatgaattaccaaaggatatgttacttatggtagtagaagaagaaaaaaaggatgaattaatagaagtaataatgaatgcagctagaacaggagagaatggaaattcaggtgatggaagaatatttgttactcctgttactgaagcatatactattagcacaaaattaaaaggcttataagggggagtgttatgaatgaaatacttgcaattgtaaggttgaataaagtatcaaagactaaaaaagctctcttagaggaaggttttccggcatttacatgtagaagagtattcggaagaggaaaagagcctgtaacttatatgttagatgatcgtactgaacaaacgtcagatcttatgtctaaaagagcatttactcttattgtatctgaaaaagatactgaaaaagtagtggatataataatgaatgtaaatagtacaggaaatcatggagatggaaagatttttgttatacctgtattggaatcttataaagtaagcactggagaaggacatgctgatgcattttaatggaaatgccttttatttaaatcttttaggttaaaatttaatttgctgttattaatagaataattatatagccttatcatgttttgatgaggctaatataattttattggttaaggaagtgagaaggttgagcgtaacaatagggttattatatgaaagtgtaaaaaatcatgatataaaactaattgctggagagaaaggattaaataaagctgtaaaatgggttcatatggttgaaaatatagaaatagcaacatttttagaaggtggagaagtaacttttttaacaggaataggactatctaatgaatttgagcttattaatcttatagaaggaataataaagtcaaaagcaagtggtatagtgataaatataggaccatatataaaaaacattgacaagaaatgtatagattactgtaatgaaacaaatactcctctttttgtggtgccatggcatgttcatatggctgagataatgagagttttctgtattaaaataactgaaaatgagaaaaattcactagaaatatctacatcaatacagaatgctattttttatcatgaacgtgaagatctatatttatcacaacttgaaattcatggatttaaaagtgaaaataaatattgtattgcggtatttgatgtgaataaatttgatatgatcaatgatgaaaaatatattataagacttaatgaatgtatagaaaattatttatctgtatattataaacaggcagtttgtgttaggataaataatcagttaatatttttatttatgaatacaacagaatctaaagtattagaaatattacaaaagattgttaaacattgtgaaagtaaacatttaataaaaagtatttttataggaattggaaaagaaacaaagagtataagatgtatatataaaagttatagacaggcagatagtgtggttataataaataggaagaagtataataatgatatttgtagatatgatgatattggaatttacaaattactttttgctatacaggatagaaatgtaataagaagctttattgatgagacaattggaaaagtaatagagtatgacagttataataatacggattattttacagtattaagatgttatcttagttataacggtagtcttcaagatacagctaatgagttatatatacatagaaataccgttaattataaaataaaaaagagtgaagagatattaaatgttgacttatcaaaacttgagataagagaaatgattgatatagcatataagctccatgatatattgtagtatgtactggagtacaaataaaatagtattaaaagacattgtacagatattcaatttaaattattatataaacatattaaggcagcaaataaaaataaaaggcagagaggtcttcttaaaataaaatggtacctatgaacaggacactttgaaaaaaagtgtctcgtttataggtacttttttgtataataataatatctatattggaggaaaaacatgagtaagataacatttgataaagaaactattgaattactgaatgaaaatccttatgtagttaaagtaagtgaaaaatctataacttactctgacgagtttaagcgattatttatagaagaatatttaaaaggaaaaacacctaaaattatttttaatgacgctggttttgatacacaaatccttggacaaagaagatacgaacaagcggcagctagatggataagatcttatagaaaagagggtattgtaggattaagagatactaggaaagaaaactctggacgaccaagtgaaaagcaattatctaaagatgatattattcaaaaacaagaagctaaaattaagttattagaggagcaattagaactgttaaaaaaattagacgtgacagaaaggaggctggtaaacagcagcttaaatctagaaggtaaggagatatttaagttaatatatgaaactatcactaataatagctataaaaatatggtttcatatttctgtgatcttttaaatgtttcacgctcgggatattataattatctaaatacacttgataatcaaatattaatggaaaataaagatttggaagctagagacaatattcttatggcttataattacaaaggttatagcaaaggatcccgttctataaaaatggttttagaaaatgagctttctataatttatagtagaaagaaaattcaacgtattatgagaaaatataatattaaatgtcctattagaaaagccaacccgtaccgccgaatggcaaaagcaaccaaagaacatacagtagttccaaacttattagaacgtaattttaagcaaggagtgccgggaaaggtattattgacggatattacatacttgccatatggaaataatcatatggcttatttgtctaccatcaaagatggtagtagcaacgatattctagcttatcatgtttcagattctataaaacttgatattgctataactactataaataaattaataacgcaccataaagatgacttacatgaaagtgcatttgttcattcagatcaaggattccattatactagtccaaaattccaaaaacttctaaaggataataatcttggtcaatcaatgtctcgtcgtggcaactgttgggacaatgcgcctcaagaatccttcttcgggcatatgaaagatgaaatagactttcaatcatgtaatacacttgaagaacttattgatatgattgatgactacatcgactattataataattacagatatcagtggaatctaaaaaagatgactcctaaacaatatagaaatcatcttttattagcttcataacactttttttatagtgtccttgacacaggatccattttaaaagtttactttaagaagaccttttttgtttaaaggaaggatgagaaaacttaaaataaaactataaataagaaggaggtttattataaataaaatatatattatgtttagaaataagataatagattagaacaagggcgttttaataaaatatataaaatgcccttgttttgttttatattaattagaacataatggaatttaattaactgtaaatttagtgaatgaggtatggatatgagtaaaaagaataagagaattacaattgaaaacatgctgacattagcaacaataattttaattttacttgtatggtttgttgtaactaattttggaattgctaattctaaaatggttcctacaccacaagcagtatggaatgcatttattgatattatacagaatggatacaaaaattatagtctacttcaacatttaggtgcaagtatggaaagattatttatttcatttttctttgctgcattaatagcagtcccatttggactagctagtggatataattcgaaaataagagcaatatttgagcccataatagaattttatcgtccgcttccaccacttgcatattatacacttcttgtattgtggcttggcattggaaatgaatcaaaaataacattattgtttttagcttgttttgcaccaatatatatatcatgtgtttcagcagtgttgaaaataaaggaagattatataaatagtgcatatacagtaggggcaagtaaatatcagatatttattcatgtgattttaccatcatgtctgccagatatatttgttggaataaggacagcggtaggggttgcatatactacattagtagcagcagaaatggttgcagcaaaatcaggacttggatggatggtattagatgcgagtaattatttaagaagtgacataattttcgttggaataattataatgggaatcacaggtattttacttgatcagttcttaaggatattagaaaagaaaattgtaccgtggaaaggtaaagaataatagaaaattagataagagtggaggaaataggttatgaatattaagaaaatagttaaaacaatagcgattctttgtacagtaagtacgatgttcatggggtgtggctcaagcaagagtaaagatgtagcagcagatggaagtcctaaggttgttaatataggaactcaacagatgcccaatgatgagggaatagcaaaagcaaagaaatattttgaagaggaaatgggagtggaaataaaccttgttgaatttgattctggtaaagatgtaaataatgcattagcatcagggagtattgattttggacttcttggatcttcaccagcaactcttggaatagcaaatggagctgatgttgaattaatatggatacatgaagtgcttggaaaagttgaatcattagctgtaagaaatgaatcaaatatagcttcaattaaagatcttatcggtaagaaaatagcaactccttttgcatcaacagcacattatagtttactaaatgcattaaaacttaatggaataagcgaaaaggatgttgaacttttggatatgcagccagcagatatttatgcagcttggcaaagaggagatatagatgcagcttatgtatgggagccaacacttgcaaatttattatctgatggaaagatattattatcaagtgctgatatggctgaaaaaggaatacttacatctaacgttgaggttgtaagaaaggaattttcagaaaaataccctgatttagttaccaaatatgttaaagcgttaaataaaggcgttaatttatacaaagaaaatcaagatgaagcagtaaaaactatatcagatgcattacagatatcacaagatgaagcgttatcacaaatgcaaggatcaatatggctttctgcacaagaacagctagatccgaaatattttggaactagtgagactaaaggtgatttagtaaagtcattaaaagatactgcacaatttttatttgaacaaaaaagtattacatcagttccagaggattcagtatttgataaagctgtaaatcctaaatatatagaagatgctataaaataatcaagcaagaaagtttatatataatttactgataaaagtgaagatgtatataagaaatgaggtatttatcttatggaagaaagaatgaatgataaaaataattatgtagtaacattaaaagatatcaatttaagatattcaggagaaaaaggtgaagtaacagcattaaaagatgtaaatcttaatattgaagaaggtgagtttatatgtgttcttggaccatcaggatgtgggaaaagtacattacttaaaataattgcaggatttcatcagccatcagatggtgaggctaaaatggatggaaagcctattaagggagcagattggcataggggagtagtgtttcaagctcctacgttgtatccttggttgaatatatatgataatgtatcattcggattaaaaatgagaaaatttcctaaaagccagatagaggaattaacaaaaagctatctagaacttgtagggttaaaagattttggaaaacataaaccatatgaattatctggaggtatgaaacaaagggcatcacttgcaagagtccttgtgaataagcctagaatgatacttatggatgagccgtttggtgctctcgatgcacttacaaggcagaatatgcaggctcttataagagatatatggaataaaacagaaaatacagtatttcttattactcatgatgttgatgaagcattagcattagccacaagaataattgtaatgtcgtcaagacctggaagaatagtaaaagaatttaagactgattttacttatgatatagcaggtgttaatcaagaaagttctagatatacttcagaatatatgcagataagagaagaaattcttaatataataaattctcaacattaaatgaattaaaaggacaacctttaaatcttattttatagataaaggttgtcctaaaacatttactaatcaatcctaaaatgttgtgtggcataaacatagccgttggatgcaatttcaaaaccaaagccaaaactgctaaaactttctctaagcatattttgattatgaccagaggattccttccagctgttaaataaacgatttgctaaatcttgtgcggacgatttagtataggaactttcagttaaataattttgagctatgttttctccattaattttttgccctgaaagagaatatacaaggttactgaaggattgtccactataatcatgagcaaaataattattatcaattaaatgcttggattttaaatatgcagattgatctaaatttttatcaatattcaattcttttatgccatttgattttctgtgattatttacaagttcatgcattttgtcacatacgatactactgaattcagcctttgaaagtaatgtgtttgaagatgaaccattatcagtagtatttaaatagcctgtccatttgccacttgcatcaaatgttgagtattttccgtctataagaacagtatcgcaagccatttcaccagaggaatgtagataataccatattccattatctaaaagccatcctgttttcatatatccattagattcaaagaagtaccaattgttatttattaatctccaacctgttgaccatgaattaccgtcagaataccaccaaccagtattatctttactccactgtgcatatgcagttgtataattcattaatgttatgctgcaaagtatagttgtggtagtgaataatttaagtaaacttctctttttcaaattaatttatccccctatatcatacaaatgttaattaaaagttaattgacaaataaatattgtaacaattaaattttacaatatttcgaataaatatacaatatattataaaataatagagaaaattacattaatttggataaaaattaagttaaactataaaaatatattaaataatggaaaagtatatttatatatggattataagttaaaaaattactgagtttgtatagagaattaaaattagggagttttataattatatatcttgaatttattcttacaataacgaatttagtttttcattttacaaggaaaaactaaaattattattgacttagagttaactttaagttgtaacatagaatcagataataggtataaaattaaaataattgaatggaaaaggagtataggtatggagtttaatgaagtttttgaaagaggaaataagaatgaagcatttgcagaatattttataggtaaaagttatttaaatatgctttctttaaaaggtgtagtaataggaaatgttacatttgaaccaggatgtcgtaataattggcatattcatcataaagggggcagatacttttaattactggtggaagaggctggtatgtagaagaaggaaaagaacctagagaattaaaaactggtgatgtggttaatatagatccagaagtaaaacattggcatggagctgcaaaagatagttggttttctcatattgcaatagaggttccagcagaaggtgcatctaatgagtggttagaaccagttttagatgaggagtataataaattaaaataattttataaatataaatacatgattttaatataactaagccctgtcttattattagaaaatagacagggcttagtttaatgtttatatgtatggttttaatgatatatctataaagttgttcttccgctatgaagaagcattcttccgataactttttttggtttttcagcatttttatttgtgctatttcccttttgcttcttttcttctattatttttttcatcatttccatttgtttttgattcatattttatcctccaatacaaagcttatgaataaaaatcacaagtttttatcaagtatatctttatcatatgcttaaaattaattacaagaaatatttaattaatgcaattctatttgtaagtgtatcataaatattaaatattttatagattgaatattatggtacgatttattttctagataccatatgtaccattagtaggatctttgaaaataaaaaactttggtggaaaaaaagtaaatagagaaaattcaattattagaattaaaataataaataaggataaagtagttaaaaaacttggaagctgagtcattgttaatatatagaaactgattttttgcccaaaatatattgatagtataaaaattaaaatatctactactaggtagttacgttttagtatttttgtgtatgaataaaatagaaatacaattgaaagaggaattataattaagcatgaagcttttgcaataacaaaattatttgttatttctgaaatagaggcatattcgagtaatgagtatattaacgtaggccagaaggcaattttaagatgttcccaagtactttcatttacggctgaaataagtgcaaatggcttatatttatttgaccaatcataaacaaagtgtagtaaggaaccagttattgaaatgaagattactcctaataattcacataaataaacattgtataccacattaacatctccttttaaatttaattatgttaatatgtattcatttagaattaaacatagtacactatttgatgtttaatttattttattaagatagtataaattttctctcagtagctcatacttcaagtaaccatagtattaatttcaataaatattgttataaactttttctatatattatattttgaaaatactatataaaaattgattttctactaggtcgggaataataaaaaaacaccagctttgaaacaagttcaaatgctgatgtttattgtaatggtgacccatacgggaatcgaacccatgatttcaccgtgagagggtgacgtcttgacctcttgaccaatgggccatacaacaataagaattatactcttattatactattatgtcaataattacattaaatataaaaaatagaaaattgaaaaataaatctatataatatatcataattttcaaaatatttaaaaaatactattgattttaatgaaaaatttggtaaactattatatagttagtaattttaaagaggtgtattataaaaaatactcatcgctcctcttgtgagataagtcacataaaattacgactcctttttaatattttgtggtatatccattaaaatttgaacttttgtttgaattttgatggatattatttttatgtaattttaaagtatatttgagaatatacataatatagtttaatgattagtttaagttaactactaaaacagttgaaatattaacttgataaaattatatacagagcagggagttggttttatggaacagagtgctcagtttgcactggtactttcattttttgcaggaatttctacagttttaggagcctgcatagtttttatatctaaaagaacaagcaagaagacaattacttttgcactgggattttctggggagtaatgatatgcatctcttttacagatctttttccgtttgcagaaagtacgttagttaagtattacggaaacttttatggagtgttgcttacaatgatgtatatgctttcaggggttatatttgcaatgcttattgataaatttataccacatgaaagtcatttactttcttcagataattcaaacaatgcaaaactatttagagtaggacttgttgccatgatagcaataacactacataatttcccagagggaattgctacatttatgtctgggtatcaagatgcagcccttggaatttcaatatcagttgctattgccatgcataatattccggaggggatagcagttgcaatgcctatatattattctacaggaagtagaatgaaggcattgaaatataccatgtattcaggtctatcagaaccagtaggagcagttcttgcttatttaatattaaaaccttttataagtgaatttttattaggattgatttttgcatttgtaatgggaattatgttatatatttcttttgaagaacttataccatcatcaagagagtatggatataatactttatcactatgctcaatatttttaggaatatgtatcatgccgattactcatatttttatgtcctaactgttcgcaatagattttataaggttttatttggaataaaaacttttaattcaaggattcaagaaaattaaaaaaataataaagcaaaaaggatagaataccatcaaaaaatgagattcctatccttttaatttttgttgaatttaattgtctatgatattattaaacttctgcaatccaattgataacagcttcatttgaacatgaggctgtttcagcgtttacttctgttacaaataatagatcaccagagttagctactgcttttaactcttttagtatatcatcagatgacatagaacatttaacaacatatgcttcaggcataacgtgtccccatgaacctaatgattttattttagaaataattttatcttcgcttgattcctcatgagtgtgagggtgagtattattatcatcgtgactgtgaccgcaaccacaaccacatgtatcgcttatgaaatatgtaattaaatatgctgacatgttttttctcctttatatatgtgtttttattagagtaccatgaacacctactatttgtaaatgaatttaaaatagaatatttaaacataaaatataatatttaaatattaaaaataaatttatgatgtaaaaaaagaaatttttgttgaaataatagctaatttgtattattatatgaataattcatattaataattaatcaaaaaaatatataaaaaacaaaatattaaataatattttgctgtgaaatatataattttttaaattacaaaagtggactagtagaattgttaagaaattttttgaggaatagtagtaggtatagtctaagtaaatttatgattaattgtaatatgatgtattggaaggttacgaagattaggaggaagaaaaatggctaagagagaaggtttttctagcagaattggttttgtgctgtcatgtattggtgcggcaattgggcttggaaatgtgtggatgtttccgtacaagcttggagaaaatggaggagcagcatttttaataccatatttcttatttatcgttgttcttggaattatagggcttatagcagaaatgagttttgggagaatgtataaacaaggatctttaggtgctataagaaaggtatttgaagaaaataagaaatctggaggaaagattttatctataattcccacattgggattaatggggatatttatgttttataccattgtaataggatgggtattaaaatatttttacataagccttacagggcaaataaacaatataaatactagtgaatattttggcggatttgcttttagttcaaattcaattgggtggcatcttcttgctgttgtaataacattagcaatagttagtgcaggtgtttcaaagggaatagaaaagattaataagataataattccattattatttattatatttattctattaatgattaaatcattaacacttccaggttcagcagctggtataaggtatttattaaagccggattgggcacatttactaataccaaaaacatgggcaatggctatgggacaggcattctttacagtttcaataacaggatgtggaatggttatctatggaagttatgcaggaaaagaatttgatatgactgaatgtgcagtaagtacagcaatttttgatacaatttcggcaatattagctgcatttatgattatgccagcagtttttgcattaggattaagtcctactggaggaccatcgttattatttataacagtcccaagtatattccagacgatgccatttggtaatttattatgtgcagcatttttcttgagcataatatttgcatctatttcatcgtctatatcgttacttgagggaccggtagaatcgatacttactataacaaactgggatagaaaaaagacaactataattgtagctataattggatttatattagctgtaccattaagtataaatgaaggtttatttaataaatttactgattttgttacaatagtactatcaccacttggtgcagttataacagcattcgttttttactacatgatagacgaagaaaagatattatctggaataaatcaaggatcaaaacgtacaataggaaaatggttcattaaatttggaaggtatgtatttgttcctgccacaataataataattgcattgggaattttttatggtggtataggctaaaagatagaattaataagaaattttttgaatttaaaaagcgctattaaaacaatagcgcttttgtattatacaattttatgtataaaaattattaaagttaaacttttataatttctatatcgcatttttctaattttttaatagaagtttcatttattcctgagtctgtaattaagtgagaaatatcatctatacttccacttaaaaatttatttttaagccctatttttgaactggatgcaagtacaaaaactggacctttacaatgatttatcatagctttattaactaatgtttcttgaaatacagatgtacttattccaaaatctacggatacaccattgacaccaataaaacacttatctgcaattactgatgaaaaaatagtagtagcaaattcaccaactaatgattgttttctttcatatacttgaccaccagttaatattagatcaacatttggacctatattagaaaataatgctttaccgttattagttataacagttactcttttatcttctaaatattcaagtataagaagagctgttgtgcttgagtttataaaaatggtatctccgtcttcaattaaatctgcagcatattttgctattttatgcttattttcattgttaagtgaattgttgttttcaaaattaatatcatttaatagtggactatcttcaataagtttagcaccaccataatatctaacaacaagtccatcattttctaaagcttgaaaatctcttcgcaatgtaagagaagatacatttaatttttcagctagttcagctgtacttatatctggatattcttttaaatattttaaaatgtactctcgtcttttagaaattatgctagtattaattttcattatatattcctccgttatataaatttacatatatgaattcatgttaagtcaatcttaatttattaaagtcttgataacataactatactatatatattgtatttattgaacaacaaatgaactcataaatatatctatttaataaaatatagtttttttatgaacaaaatgaattaataattgaacgtaaagtttaaaacattcaaaaagttcatttaatatagaaaattatagcattgtcgaacaaaaaaatcaaataaatataaaaaaagttaaaaaagtattgaactatatgaatgtttggtgtattattaagtcatggataggaaataaatactatttaagagaaaaattaaaatgagaattggaatgggggaatttaaaatgtcacaagtagaagaaattacaagagaatcatggatattaaatacttttccagaatggggaacttggttaaatgaagaaatcgaaatggaagaagttaaaaaaggaacatttgcaatgtggtggcttggatgtactggaatatggcttaaatcagaaggtggaactaatataagtattgacttttggtgtggaagtggtaaaaaaacaaaagctaatccttatataaatccacaacatcaaatggctagaatgtgtggtggaaaaaaacttcaacctaatttaagagtagcaccatttgtgttagatccatttggaataaaaaatatagatgcagttcttgcaacacatgatcataatgatcacattgatgtaaacgttgcagcggcagttcttaaaaattgtagcaaagatgttccgtttgtaggaccacaagcatgtgtggataaatggataggatggggagtgcctagtgaaagatgtattgttgtaaaaccaggagatacagtgcagattaaggatatcacaatagttgcattggaatcatttgacagaacagcattgataactgaacctccaaagggagatatcagaggaaagatgccagtagatatggatattaaggctgttaattatttgataaagacaccaggtggaaatttatatcatagtggtgattcacactattcaaatttttatgccaaacatggaaacgaatacaaaattgatgttgcattaggatcttatggtgaaaatccaagaggaattactgataaaatgacatcagttgatattttaagaatggctgaagcattgaaaactaaagttgttattccattccatcatgatatatggtcaaatttccaagcagatacaaaagaaattttagagttatttgatatgagaaaagatagattacagtatgaatttaatccatttatatggcaagtgggaggtaaattcacattccctgatgatagtaaaaagagagaatatcattatccaaggggatttgatgattgttttacaacagatattaacataccatatacatcatttttataaaattgcttaaaaagcatagttttttaaaagtggttttaaatttatcttattaagaacatatgtaggtaattgttatggaactgctataaaagcaaaatagcagttccaatataaaagggggaaacagaaatgttaaaggaattaattgaaaagaacagattttcctttcatgatggttttgaaaaatgggaggatgcaataaaagcagcatgtatgccattaattaaagataaggctattgaagaagcatacattgattcaataatcagcaatgttaataaatatggaccatatatagtaatagcgccggatatatgtataccacatgcacaggaaggtgctgtaggagtaaatgaaacagcagtttgctttatgagaagtaaaaagccagtttgttttagtgatgaccatgatcaagatgcaagactattttttgttcttgcttcaacagacaataatattcatttggagaatctttctaaactagttgaattagtggaaaataatgaagtagtagaagaattgatatgttcacagtgtaaagaggacttagaaaacatatataaagattattttttaccagcttaagggtaattaaattttaggaggaataaatatggagatattattaagcatctggaaattttttcaggtaaacatattgactaatccagcgttttttataggatttattgtacttataggttatttattattgaaacgtcccatatatgaagcaatagcgggctttatcaaagcaacggttggttacctcattcttaatgtagcagctagtggattagttggaaattttagaccgatattagctggattaaaagatcgttttaatttagcagcggcagttattgatccctattttggacaaacagcagctcaacaagcagttgaaaatgtaggaagatcattttcacttatgatgatagttcttctaatagcatttatatttaatattgttttagtattgtttagaaagacaacaaagattagaactgtatttattactggacacataatggtacaacaatcatctacagcgttatggattgtattgttctgttttcctaatttagttgatacaaaagctgttataatgcttggaatattacttggaacttattgggcagtatcatctaatcttacagttgaagcaactcaggatttgacagaaggtggaggatttgcagtagggcatcaacaaatgtttggtatttggctaactgataaaattgcaggtaaaattggtaacaaagaaaaatcaattgaacatttagaatttccaggatttttatcaatatttaatgataatgttgttgcaacaggtatattaatgatgtttttctttggaacaattataggtatactcggaccagatttaatgcatcaaatagacacaggatttgcagcaaataaaaactttatattctatataatggaaaaatctttaaattttgcagtgtatttaagtatattacaacttggtgttaaaatgttcgtatctgaacttactgaatcattccaaggtatatcaaataaaattttacctggatctatgccagcagtagattgtgctgcaacatatggttttggtcatgcaaatgcagtaacaataggtttcttatttggagcattaggacaattcatttctattattggattaattgtattcaagagcccagtattaataataacaggtttcgtaccagtattttttgataatgcaacatttgcagtatttgctaatagaaaaggtggattaaaagctgcaatgattatacctttcgtctctggaataattcaagtattaggtggtgcttttgcagcatggtactttggattagcacaattcggagggtggcatggaaactttgactttgatacagtttggcctgttatcggagtattaatgaaaaatttccaatatgttggatttggaatagtaataattgcattattagcgataccgcaaattcaatatcttaagaataaaaaaggttactttaaaatagcagaagattatgaggaatacatggaagaaatgagtcaatcagtataaaataattgaaaaagggtgattaattatgttaaaagtaatagcagcatgtggaagtggaatgggatcaagtcaaataattaaaatgaagataacaaaagtatttaaaaaattaggaatagatgtaacaattcaacatagtagtgttggagaagcaaagagccaagcatcaagttttgatgttgtattctgttcagaggttttaaagtctaattttaaaagagcggaagattcaggaacaatagttatcggattaaaaaatgtgttatcagaaaaggaaattgaagaaaaagtaatggaaaaggttgtaaataaaaaatagtattttgcaatataaaaaatggaggtgtagactatgaagattgaaaaaaagaacttagatgaaatgtatcgtgcatatgcatcaagctcaattgaaatagatggcaatcttaacttgcttatagcatctgaagaaaaaggatatccatgctattcatatagtggaaagaattttaatcatcgtcagacagtatgggaagatggaggcggatgtatgtcaattattccaattccaaatagagcaaatgaatttttggcagtacgtgatttttatcttaaagaaagtccaagcagtgcacgccttgtatggggacacttagtagacggtgagtgggttactgaaactatattgaagcttccttatctacatcgttttgatttatgggatgttgaaggagaaatatattttattggtgcaacaatagcagatcttaaagataataaggaagactggagcagaccaggtactatttattatggaaaactaccagatgtattaacagagggaatagaacttgaagttcttaaaacaggattgtttaggaatcatgggtatagcagtcatatggtagatggtaaaatacatggaacttttggatgtgatcaaggagtatttgaagttgttcctatgaagaatgaacagtggcagataaattgcattcttgagaagagtgttggagaaattgcttggtgcgatatagataatgatggaattgatgaaatgatgacaatagaaccttttcatggggattcaatgaaaatttataagttaactaaaggaaaatatagtgaaatttactcatatccatatgaaatagattttgcgcacacccttgtaggtactaagctttgtggtgaaccggtttttgtaggtggagtaagacgtaaagaagctgagttatttatgattcaatatatagatggaaaatgtaaggaaacaataattgaaaaaggtgtaggtcctgctaatattcatgttattaatttggatgattgtgatttaattgtatctgctaatcatacagataataaagcagcagtgtatacagtaagaaaggaatagagtactaaaatattaacatttatctatggatattatagaaattataaataatgtccatagataaaaaaatataaagaattaaatgataataaaaatcaatgataataaaaatcaatgataggggtgtcatatatgttagaacaattaaaagaaaaagtatatgaggctaatatgcttttgcctaaatataatcttgtaacatttacatggggaaatgtttcagcaatagatagagaaagtggactagttgtaattaaaccatcaggtgtcgaatatgacatcatgaaacctgatgatatggttgtagttgatttaaatggaaacatagttgagggaagatataaaccatcatcagatacaccaacacatattaagctatataaggatttttgtgatataggcgcagtagttcatacacattctagatatgcaactatcttttcacaatcgggaaaagatattattccctatggaacaactcaagctgactatttttataatgagataccatgtacgcgtgatatgacagcagaggaaattagttcaaattatgaatataatacaggcggagttatagttgagagatttaaacatttaaatcctaattatgtaccagcggtgttagtaaaaaaccatggaccgtttgcatgggggaaagatgctatggaagccgttcataatgcagttgtacttgaagaagtagcaatgatggctcttaatacagaattattaagtaagagtgaaacagttaaaatgccacaagagcttatagaaaaacattttactagaaaacatggacccaatgcttattatgggcaataaaaaataattttagactataaaaagttatttagatattttaataaataattacttagaattttattaatagaggtgttcggtatgaaagaatatactttaggattatatgaaaaatctatgcctaattatcttacatgggaagaaaaatttagttgtgcaagagaatgtggatttgacaatatagaaataagtatagatgaaacaaaagaaaaattatcaaggatatatatgtctaaaggtgatagaaaagcacttgttgagttaatgtttaaatatggtgttgaaataaggacaatgtgtttgagtggacatagaaaatatcctcttggaagccttgatgaaaagatacgaaataaaggcatggaaataatggaaaacgcaattgagcttgcagatgaccttggaataaagataatacagcttgcaggatatgatgtttattatgaagaaggaaatgaagttacaagaaaacactttaaggaaaatttaaaaaaggcagttgaaatggcagctagtaaaggtgttattcttgcatttgaaacaatggaaacagaattcatgaatactgttggaaaggcgatgacgtttgtcaaagaaataaactctccatatcttcagatatatcctgattgcggaaatgtgactaatgcggctttggaatatggacttacgcctagtgaagattttgaatctggaaaaggccatatagctgctgttcatttaaaggaaactgttccgggaaaatttagagaagttacttttggaaaaggacatgttaattttgaagaaattataaaaaagtcatgggatcttggtgtaagaaaatttacagtagaattttggtatacaggcaatgatgattggaaagatgtaattaaagaaactaaatattttattgatgataaatttagaaaagctttatgtgaaaatatgaaagctgtttaattatctagatactaaaagaaattaacatcaacatgtatgttatgaaaggttgagtgatttatggataaaggcaaattagatttagtaataaagcaagttaaaagaaatattatagaaatgatctatgaagcaaagtctggacatccaggaggatcattatcttgttcagaaatactaacatatctatattatgaaaagatgaatgtaagtcctgaaaaatcaaaagatgactgccgtgatagatttgttttaagtaaaggacatgcagcgccagcactttattctgtgctagctgagaaaggttactttaataaagagcaacttatgagtttgagaaaaattggtggcttattacaaggtcatccagattctaaacatattaatggtatagatgtatctacaggatctttaggacagggaatttctaacgcagctggaatgtcattaggacttaaaatgttagaaaaaaaatcaaaagtgtatgttctacttggagatggtgagcttcaagaaggtcttgtatgggaggctgctatggcagcaggacattacaaacttaataatctaattgctattatagacaataatggattgcagatagatggaaaaaatgaagaagtaattactattaacccaatagacaaaaaatttgaaagctttgggtggaatgtaatctcttgtaatgatggaaatgattttgaaagtatcaataaggcatttttagaagcagaaaaatgcatagataagcccaatgttataatagccaaaactattaaagggaaaggtgtgagttttatggaaaataaagttgaatggcatggagcggcaccaaatgaagaagaaaaaaatagagctatagaagagattttagcataattttaaggagggttttatcatgggaaaggcaactagggagtcatatggtgaagcattgattcaaattggttatgaaaataaaaatattgtagtgttagatgcagatctttcaaagtctacaaagacaaatggatttaaaaaagaatttccagatagattcttcaatgctggaattgcagaacagaatttaatggggatggcagctggaatgtctaatattggtctagttccttttgcaagcacttttgcagtatttgctactggaagagcatttgaaataatacgtaattcaatatgttatccaaaagctaatgttaaaattgctgcgactcatgcagggataactgtaggagaagatggaggatctcatcaatctattgaagatattgcactgatgtgttcactacctaatatgacagttatagtaccagcagatcacagggaagcaatggaagctactaaggcagctgctatgattgaaggacctgtttatttgagatttggaagatgcaatacagaagatatttttgatgatagctataaatttgaaattggaaagggaactgaaattaaaaaaggtgatgatgcagcaataattgctactggaatgatggttcaaaaagcaattgaagcagcaaaataccttgaatcagaaggaatacatgtacgagttataaacatatcaacaataaaacctatagataaagagattattataaaagcagcaaaggaaactaaaggtattgtaacagcagaagaacattctattataggtggacttggatctatggtatcttctgttgtatgtgataaatatccatgtaaagtaaagatgattggaattgaagataaatttggagaatcaggaacacctgatgagcttatggagaaatttaagcttacaagtgatgcaatatcagaaagtattaaagaaattattaaataaaaaagtgtacaagtgggtacacgagatatgaataggagagttatataatgaaaatatttgtagatacagctaatgttgatgaaataagaaaagctaatgatttaggcgttatatgtggagtaacaacaaatccatctcttattgcaagagagggaaaagactttaatgaggttataaaggaaataacaagtatagtagatggtcctataagtggtgaagttatctcaatggaatgtgaagggatgattaaagaagcgcgtgagatagggaaaattcatgaaaatatggtagttaagattccaatgtgtgaagaaggattaaaggcggttaaagtattaagtaaggagggaatcaaaacaaatgtgactttaatattttcagcagtacaagcgcttcttgcagcaagggctggtgcaagttatgtgagtcctttcttaggaaggttagatgatattggaagtgaaggaattaaattaatagaagatattgcagaaatatttgcaattcatgatattgatgctgaaataatatcagcaagtgtaagaaacccaattcatgtattggattgtgcaaaggctggatctaatatagctacaattccatacaatgtgatagttcaaatgataaaacatccattgacagataagggaattgaaaaattcaaagaagactatagaaacgcatttggtaaataatatgaatataagtaattcaaaaacaagtaatattataaaaatagccccttcaatattatcagcagatttttcgaaattaggttctgaactagaaattattgatagggcaggcgcagattatgttcatattgatgttatggatggattatatgttccaagcatatcattgggattccctgtaataaaaagtataagaaaatatactgaaatgatatttgatgttcatttaatggttcagaatccagacaaatatatagaagaagctgcgctttctggagcagatattataacagtacatgcagaggcgagtactcatattcatagaaccattcagaagataaaagaatgtgggaaaagagcctgtgtagccataaatcctggaactaatatagatgttttagagtatatattggaagatttggatatgattcttttaatgactgtaaatccgggttttggaggtcaagaatatatagaaacaatgactaataagatatctagactaagaaaaaagcttgatgaacgaaatttaaatattgatattgaagtagatggtgggattaagcttagcaatgcagagtcagtaattaatgcaggtgccaatgttttagtttctggttctggaatttttaaaggaaatatagaagagaatattaaaggttttaaagctatggttaagtgatgtttataaacaaaacataagtgtatttatggtgtttttaaaagtctatatatagttaaaaaataagtctgtttatcaaaattatatgaaattttgataaacagactttaattttgaaaaatattaaaataaattcaaataataacatttaagtattaataatataaaaaacattacccataaaattgcataaaaaagtataatgttttcttaaaacagtattataccagtctgtgtaaattgttgagatatatccatctattaatttttttattgtattttcttttgttaattgaagatatagtgcacatccaaaaagtaagataattcctatggcaagtatatatttagttgtattttcaacattaaaaatacataaagatagtccacttaaaattacaccaataattgtaaagtatgtgatatattcaatcttcttttttgtctttactatatcatcttttaatttgtttactgtaataacatccttgaaaaaaacatgaagcttgtccctataacattccaagaatttagcttttatgtatgaataatattcagtgttatttatttcgtctatgttcatacacattatcagtggataactgtattcagtaagtttattgtatacaaattcatcacgtttttccatgcttggtattctaacaagcaattctccatttggatccacaattaatgtataattatcatttacagaacttatatacgaatcacgtataatttctaaagcttgtctttcatatggatttttatcatgaatatgttcaagaagaatgtctataatagtcatataaatacccctttcataatagttaacatatatatataattatagcattttatcaatattatttaaatattaaagaataaataataagttaacacaagtatagtattattcatataatataccacaggaaactgtaataaatatacaaaagaaagtgtggtgataattatggatgtatcacaatatatcacacagaatgcacttatcttaatacctgttctttatataattggaatgattataaagaacactgataaaataagtgataaatatatacctttaatactacttgtttttggtattgcaggaagtatgggaattatcggagtaaatgctaatgcagtaattcaaggagtattggttacaggagctacagtatatactaatcagcttataaaacagacaggaaaagataaatagattaaaagacagttttatattttatagagtaatcatggctttgtcattagatttagtggcaaagcctttttattttatatatcaaagatattaaaagtatagagtttatgactggtattttataataagcaaataatattttaacattaaaaatactgatattacgaataaatacaattaatgtatagaataataattataaaaagcattgacaaaatatgtgtgtaaatgttatcatgaatttgcaagacaagtagacaagttaaaatacaagtttaaagattgtgtaaagttgtaaaaatatatttaagtagtggaggaattgtgatgaattattcagaaggttcaggaaaacaatatcatattgctgtaggtgaaggtgaagttggaaaatatgtaatacttcctggtgatcctaagagatgtgaaaaaattgcaaaatattttgaaaatccagtacttgttgcagataacagagagtatgttacttatacaggttatttagatggagaaaaagttagtgttacatcaacaggaattggtggaccatcagcagcaatagctttagaagaattagttaaatgtggagcagatacatttataagagttggtacatgtggtggaatggaacttgatgttaagggtggagacattgtagtagcaactggttctataagaatggaaggtacaagtaaagagtatgcaccaattgaattcccagcagtagcaaattttgatgttgtaaatgcacttgtagatgcatctaaaacattaaataaaacataccatacaggagttgttcaatctaaagactcattttatggtcaacattcaccagaaactaaaccagttagttatgaactagaaaataagtggaatgcatggctaagatgtggatgtttagcatcagaaatggaaagtgcagcattatttattgtaggaagttatttaagagttcgtacaggagcatgtttcttagttattgcaaatcaagaacgtgaaaaagcagggttagataatccacaatctcatgattcagaagaatcaattaaggttgcaattgaaggaataagaaatatgattaagttagataaaaaaaaggcagctaaataataaaaaaatgttttagaaaatttagcggattttctaaaacattaataatgaaagtttatttcagtacaaaataaaaatcatataaacatattataggacaaaatgaagtgaaaatcaaaaaaataaataatctacaattctgcatttaaattaagcagaagataaatgttaattagatttacagagtggagagttaagttatgaaaatatttataagcattattggtattattgtagtattaggatttatgtatttattatcttccaatagaaaagagattccgtataaaacagttataaaagctttgggaattcaatttgtaattgcatttttacttgttaaatttccactaggaagattaattgtagaaaagatatctgatgttgtaactggagttttaaactgtggaagagaagggctgttatttgtatttggaagccttgcagatggaggagcaccaacaggatttgtatttggtatacaaacacttggaaacataattttcgtttctgcattggttggagcattatattatcttggagttataggatttatagtaaaaataataggtaaagctgtaggaaaagtacttggaacaagtcaagttgaaagctttgttgcagtagcaaacatgtttttaggtcagacagaaagtccaattttagtaagcaaatatttagggaaaatgactaagagtgaaatcgttgttgtattagtttctggaatgggaagtatgtcagcgactataattggtggatacacagctcttggaatacctatggaaaatttacttatagcaagtgcattagtacctatgggaagtatggcaattgcaaagattttaacaccagaagttgaaaaaggtgaaaatttagataatttatcaatagataataaaggggataatgcaaatatattatcagctatttcagaaggtgcgattaatggaatgaatacagcacttgcaattggagcttcacttatagctgtattaggattagttgcaatagtaaatatgtttcttggatactttggtttaagccttgaacaaattttctcttatgtttttgcaccattaggatttcttatggggcttgaaggaagtgaagtgttaacagcgggtcaacttttaggaagtaaattagtattaaatgaatttgtagcattccaatctttaggagaaattataaattcattaagtgaaagaacaggattaattttatcaatttcacttgcaggatttgcaaatgtttctagtattggtgtatgtatttcagggattgcagcattatgtcctgaaaagagaaatatactagcaaaacttgcttttaaatctatgttaggaggattttcagtaagtgtgctaagtggaatgatagtaggtattattacattactttaatatagagatgttgtattaataattataagtattattagaattagttaaaggggagattattatggaaaattataaagaacttttagaaagagcatttaaagcaatggaaaatgcatatgcaccatattctaattatagagttggttcctgtgttttaactaaagataataaatattttattggtgcaaatattgaaaatgcatcttatggattaactaattgtgctgaaagaaatgcaatttttcaaacttattcaaatggatatagaaaagatgatgttttagcaatagcaatagtatgtgaaggaaatacgcttgctgcaccatgtggagcatgcagacaggtattagttgaacttttaaataaagatacacctatagttttatcaaataagaaaactgaaaagatatgtacaatagaagaacttatgcctatgtcttttacaagttcagatttagcataaatatatgcttacaaagtaagtatacataagggattcattttatggttaaaatattaattcataaaatgaatctggatataattataagatttatggccttaatgacctaaagagagggaaggatgattgtagttatgaaaaaatataatagaatttttacaatagtaatagattcacttggaattggacagatgaatgattcagaaaaatatggtgatgttaatgtagatacattaggacatattgcagattcagtagaaagttttaatattcctaatcttcaaaagttaggattagcaaatttacatcctataaagcatgtaaaaagtattgaaaaaccacttggatatgcgatgaaaatgagagaagcaagtgttggaaaagatacaatgacaggacattgggaaatgatggggcttcatataacaaagccattccagacatttactgatacaggatttcctaaagaattgttagatgaattagaaaagagaacaggacataaaattgtaggaaataaaagtgcaagtggaactgaaatactagatgaacttgctgaacatcagatgaaaacaggtgatatgatagtttatacatcagctgattcagtattacaaatctgtggacatgaagaaacatttggattagaagaattgtacagatgctgtgaaatagcaagagaacttactcttaaagatgaatggaaagttggaagagtaattgcaagaccatatttaggggataaggaacatggttttacacgtacaagtaatagacatgattatgcattaaaaccatatggtgaaacagctctaaatgcgcttaatgataaaggatatgatgttatatcagtaggaaaaataagtgatatatttgatggtgagggtataacagaatctcataaatcaaagagttcagttcatggaatggaacagactttagagattatggataaagattttaaaggtttatgttttgtaaatttagttgattttgatgcattgtggggacatagaagaaatcctaaaggatatgcagaagaattagaaaaatttgatgtgaatttaggaaatatactagataaacttaaagaagatgatttattaataataacagcagatcatggaaatgatccaacatatacaggaagtgatcatactcgtgaacatgtgccatttatagcatattcaccatcaatgaatggaaatgggattttagaaacatgtgatacgtttgctacaattggtgcaacaatagcagataattttgatgttaaaatgccagaagatacaattggaaaatcagttttagaaaaattaaattaaataatttaatatacacaaaaaagataggttggtggaaaaatgaataaagataatttaaatcaaatatgtaaagaagttaaaaaagatattattgaaatgatatatgaagcaaagtcagggcatccaggtggatctctatcatgttctgaaattctgacttatctatattatgaaaaaatgaatgtaagtgttgaaaaatctaaagatgaaaatagagatagatttgttttgagtaagggtcatgcagctccagccctatatgctgtattagctgaaaaaggatatttctcaaaaagtgaacttaaaagtttaagaaaaataggtggtttattacaaggtcatccagatgctaaacacattaatggagttgatgtttcaacaggttctttaggacagggaatatcaaatgctgtaggaatggctcttggtcttaaagcattaaataaaaattctaaagtatatacaatattaggagatggagagcttcaagaaggattagtatgggaagcagctatggcagcaggtcactataagctaaataatctagttgcaattattgataataatggattacaaattgatggtaagaatgaagaagtaatgaatgttaatcctttagatgacaagtttagaagctttggatggaacgttgttttatgtgatgatggaaatgattttgattcaattgataaagcattttcagaagcagataagtgtagtgataaaccaactgttattattgcaaagactgttaagggaaaaggtgtaagttttatggaaaatgaagctggatggcacggtgcagcccctaatgaagaagaaaaaaataaagcaataaaagaaattcttgcataatataaaggagaagtttgaaatgggaaaagcaacaagagaatcatatggaatagcattagttgaacttggtcatgaaaatgaaaaggtagtagttttagatgccgatctttcaaaatcgactaaaacaaatggatttaaaacagaatttaaagatagatttttcaatgctggaattgcggaacagaatttaatgggtatggcagctggtatggcaaatgttgggttagttccttttgcaagcacttttgcagtatttgcaagtggaagagcatttgaaataataagaaattctatctgttatccaaaagtaaatgttaaaatagcagcaactcatgctggaataactgtaggtgaagatggtggatcacatcagtcagttgaagatatagcacttatgtgttcacttcctaatatgacagtaatagtgccagcagatgatagagaagcaagagcagcaactaaagccgctgctgaatttaaaggacctgtatatttaagatttggaagatgtaatactgaagatatattcaatgaagattataagtttgaaattggtaaaggtgttgaacttagagaaggtaatgatgtaacaataattgcaacaggaatgatggtgcaaaaagctattgaagcatcaaaacaacttgaaacagaaggtattaaagcaagagttataaatatgtctacaataaaaccaatagatagagaaataataattaaagctgcaaaagaaacaaagggaatagttacagcagaagaacattcaataattggtggacttggagctatggtttcagctgttgtatgtagtgaatgtcctactaaagtaaaaatggttggaatacaagattcatttggtgagtcaggaactcctgatgaattaatgaaaaaatacaaattaacatctgatgagatagttttaaaagtaaaagaaatggtttaagcaaaaataagatttgatttatgtgaaattttagtgaatgtataattaaaatcctaataatttaggtgtatataaatatgaaaataatggaggaataaaaaatgagcatacatataaatgcaaaacaaggcgaaatagcagaaagcgtattattaccaggagatccacttagagctaaatttatagcagatacttttttagaagatgtagtttgttataatgaagtaagaggtatgtttggctttacaggaacatacaaaggtaaaagaatttcagttcaagggacaggaatgggaattccttcaatgtctatttatgcaagtgaattaattaatgaatatggtgttaagaaccttataagaataggaacatgtggtggataccatgaagatgttaaagtaagagatgttgttatggcaatgtcagcatgtacagattcaaatcttaatttaacaagattccaaggaagaacttatgcaccaacagctaattttgaattattaaagaaagcttatgatactgcagttgaaaaaggtattgagcctaaagttggaactgtatatagttcagatatattttatggagatgacaatgaagactggaagaaatgggcagcttttggatgcttaggtgttgaaatggaagcagctggactttatactgtagcggcaaaacatcatgtaaaagcattagcaattatgactgtaagtgatcattttattacaggtgaagttacaagtgcagaggaaagacaaacaacatttaaaaatatgatggaaattgcacttgatgctatagtaagtctataaattaaagataaatagaaaaataatttatgcagatataatgagttagaataaaggagtattatggtatgaaaatttttgttgatacagcgaatatagaagaaataaaaaaagcaaatgatttaggtgtaatatgtggagtaacaacaaatccatcacttatagctaaagaaggacgtgactttaatgaagttataaaagaaataacatctattgttgatggtcctataagtggtgaagttatttctatgaattgtgaaggaatgcttaaagaagcaagagaaatagcaaaaattaataaaaatatggtagtaaagattccaatgtgtgaagaaggcttaaaagcagtaagtattcttagcaaagaaggaattaaaacaaatgtaactttaatattttcagcacttcaagctttattagcatctagagcaggtgcaacttacgtaagtcctttcttaggaagattagatgatatcggaagtgaaggaatcaaattaatagaagatattgcagaaatatttgcaattcatgatattgatactgaaataatctcagcaagtgttagaaacccaattcacgtattacaatgtgcaaaagcaggatctgatatagcaacaataccatataaagtaattgttcagatgataaatcatcctttaacagatgcgggtattgaaaagtttttaaaagattatgaaggtatgaataaataaatctatatagataaaaaggttatgtcagaatgataattaaatcattctgatataaccttttctttgttgtttgtaaattataatgtaaataaattagtcttagattgcttaaatgtaatccaagactaatttgattgatatatatatttgtatgatagaataaaaagtttttatttaaatgagtttattttaattgaacttatatctaatggaagataatgcttgttatagacagctggattattatctgtacttgtgtataagctttcttgtattaagtgacattgaccattagaatataatgagtatttttttgcagtaaagcttcccgatgcagagtgttttatttcaattgtggatttcgatgatcttgaatatatatcattttctaagaactttaaaagttcttctttactgtttaaatcaatattattttcagaaattgtttctattggaattaatgtaaaactataagcaactacaatatcatttgatttataccatctatcaacaacaacacatacagctgtctttttttgtagtatctgaagcatatagtcatttggaagttcgatatgaaaatctatttctacatcatctatagtttcattaatgcatttataaataggattatctattatttctaaacctgaacttttgtcagatgtagacttttgtatgaaatttccttttccttgtatattttttataagaccatcatcttgtaaaagggcaagagcttgtcttagagtagttctgctcactcctaaagattttgcaaggtcaggttcactaggaagacgtgcaccatctttaaaaattccctcattaatcattttaaataatttatcatatacggcaacgtaacgtagttgtttttgattattttctaaattaactttatccataataatatcaccttttcacatagcaagtatttttaacttgtataaatattatttaattcatacaaatcatgaattgagtatatatattataaatgatttacataattataatttaatatacataatttttaattgtatatcagatttgttttattccatttaggtatcttttagtgaatgtacaaaaaattagtaactttactaaaataacgttactaaataataagatttaatttatataaagtttactttatatactattaaatataacaaatttttttgaattttactataaaatatttttatagtatcaattaaaagtaaaaaaatatatcacaaataagaaaacaactatacaatttaaaatacaaatgttataattgtacgggttttgttgaaggtcttaacaaaagaaaattattatttaggagagaaaaagatgaaagtaattatgagtttacttggaatagctgttgtatttggatttatgtatttattatcatcagatagaaagaatatcccttataagacagttataaaagcattgggaattcaattattaattgcagtggtgttacttaaatttcctttaggaagatatgtagtacaaaagatatctgatgtggttacaagtgttttaaattgtggaaaagatggtatagcatttgtatttggaagccttgctgattcgagttcggcaacaggtaatatatttggaattcagactcttggaaacataatattcgtatctgcattagttggagcgttgtattatttaggcgtagtaggttttatagtaaaagttattggaaaagttgttggaaaagttttaggtacaagtcatgttgaaagctttgtggcagttgctaatatgtttttaggacaaactgaaagtccaatattagtaagtaaatatttgggtaaaatgacaaagagtgaaattgttgttgtattggtttctggaatgggaagtatgtcagcgactataattggtggatatacagcccttggaattccaatggagtatttacttattgcaagtgctcttgttcctatgggaagcatagcattatcaaaagtattaatgcctgaaactgaagaaacttttgatgttgaagagttgaaaattgacaataaaggtgataatgaaaatatactatcagctattgcagaaggtgctatgagtggattacagactgctttagcaattggagcatctcttatagctatattagggttagttgctatagtaaatttaattttaggattctttggattaaatcttgaaaaaatattctcatatatatttgcaccatttggatatctaatgggattagatggaagcgaagtatttatagcaggaaatcttcttggaagcaagcttgtattaaatgaatttgttgcatttcaatcattaggtcaaatgatttcagaattgagctatagaacaggattgattttatctgtgtctcttgctggatttgctaatatatcaagtattggtatatgtatttcaggaatatcagcattatgtcctgaaaaaagaaatattctttctaaacttgcatttaaatcaatgcttgctggattttcagtaagtcttttaagtgccataatagttggattagttacattaatatagaatttatggcgattagggcgtgatgtacaaataaatgcattgcgttctaatttttattatttagaaatcaataaagaatacaacaaaaagacatgtataaaatagtactttatattcttgaacatttcatataaaattaatttatagagtaatattactaattattctagcaaggaggaaaacaattatgaaaaaatataatagaatttttacaatagttatagattcattagggataggtcaaatggatgatgcaaaagaatatggagatgtaaatgttgatacattgggacatattgcagaatcagttgaaagatttaatatacctaatcttcaaagattaggtatatcaaatttacatccaataaagcatgttgaaaaagctgacaaagcattaggatatgcaatgaagatggcagaagcaagtgttggaaaagatacaatgacaggtcattgggaaatgatgggacttcatattacaaagccattccaaacatttactgatacaggatttcctaaggaattattagatgaattagaaaagagaacaggacataaaattgtaggaaataaaagtgctagtggaactgaaatactagatgaacttgctgaacatcagatgaaaacaggtgatatgatagtttatacatcagctgattcagtattacaaatttgtggacatgaagaaacatttggattagatgaactttatagatgttgtgaaatagcaagagaaataacattaaaagacgaatggaaagttggaagagtaattgcaagaccttaccttggggataaagaacatgggttcactcgtacaagtaatagacatgactatgctttaaagccatatggaacaactgtacttaatgttttaaaagatagtaattatgatgttatatcagtaggaaaaataagtgatatatttgacggtgagggtataacagaatctcataaatcaaagagttcagttcatggaatggaacaaactttagaaattatggataatgattttaaaggattatgttttgtaaacttagttgattttgatgcattatgggacatagaagaaatccaaaggatatgcagaagaattagaaaagtttgatatcaatctaggtaaagttttagataagcttaaggaagatgatttattaataataactgcagaccatggaaatgatcctacatatataggaagtgatcatactcgtgagtatgtaccatttatagcatattcaccagtaatggaaggaaacggagtattagacacttgtgatacttttgctacaattggtgctacaatagcagataattttaatttgaatatgcctgaaaacacaataggtaaatcaattttagataaattacaatagtattataatgcccatttgtcaattagacagatgggcattaatttagaattaaattacttttatgttatttataaaaatatgatttaaatattataagagattgtcttatggttgacatgcagttatgatattatagtattaaaaattaagggggatgggatttgctttggtttagtttattcaatgtaagcaagaagtactacataactatttttattgtaataagtcttattgtgagtttcagtgcttttaatatgataactatagatagaaatgtacaggcttcatatataaatagcagagtaaaaggaattaatatttctaataatgatggtaatttagatttatcttctgtaacacaagcaggtggtaaatatgtttatttaaaagcaacagagggagcaacatttagggattcatatatggatacatattataatcagtgtaaagatcttggaatgaaaattggagtatatcattatttggtgaatacaagcagcccagaagaacaagcagaaaatttttataatactatatctaaatataattgggatcttatacctatgttagatacagaagtttatttcgatggacttgaagattacataaagagatttaagattgcttttaacaaattatcgcctctaaagttggggatttatagctatacaagttttattgataaatatttaaataatgctgattctgaaatatatgaaatgcctttgtgggaggctaattataatggaaaaccttggagcagtgttggggataataagtttacaaatttagtcggacatcagtattcaacagaaaaacatattagtgattatattggggattttaatggtgatcttaatgagtttaatgaaggctgcctaataaatcaataagaatatataagcataagcaaaattagttctggtttttttagaattgtctaaaataaaactagaactttttgtagttatttgaactaaatatatattttaaataataaacaacatatgacactagaaatttaatatataaaaattgttaaaattaatacataaaaatataaaaaataataggaaatatttaaaaagtttgaattttgtgctaatattatctagtaattgtttaaaaaggaacaaataatagacaaataaacaaaaatgtctagggaggaatattataatgaggggtaatagtaatcggaagaccataaaaagagaacttattaaaaaaagtggatttgtatttgcagctatcttcataattgtatttttgattacaatatctatatccaaggggacgttgcttcatgttagcttagcaagtatagagaatttaatgggcaaatcacaacttgatataggagatagaatacaagaaaaatttataatagctgaatctattgcaaacaatcaattaattgcagatgaaactataccatttgaagataaaaaagcaagtttacaaaaatatgttgaaaaattcaacttaaggtctatcggatacatagatagaaatggatatttaaggagtacagatggttttgaagcagactcaagtcaggaaccatacttaaaaattttaaaagaaggtaaaaattatttgagtgatcctgtttttacttctgatacaaaagaacagattgtatttgtaggtgttcctattaaaaatggaaatgaaattacaggatatattacttgtactgttgaatgtagctatttatctcagcttacaaatgaagtcaaatataatggaataggaaagtcatatttaataaatagcgatggaataataattggatcagaggatttaaatgatgttagtaatggtgtaaacataattgatacaattgaatctgataaatacacagacaataaaaagaagatatatgaaaaagccataagcggtgaaaatggaagtgatagttcgactaatgaggttattacatatacatctgtaaataatacaaatggttggagtttaattttagaagtagacaatagagatttttataaagatataagaacaataacaattgcaagtatcgtaatagggatagttggactgagcgtagtattattctgcttagtgttaataggagaagctctagggaaaagacttataaatgtaaaacaagctatagatttacttgcccatggagattttaatatagaattaagtgattatgtttttaaagttgaagatgaagtttttgacataggtaattcaataaagaaaacatcatcatcaatgggagcaatgattaaaaaaataaaaaatgatgtttatataataaatgatcagtctgatgtactgagagaaacatcaagagaaattgataatggagctaatggactttcaattgcaatggatgaatcagctcaaggaaatacaaatcaagcatcagaaattttaatgattcataacaaaattggcgagctaggtgataatatagaaattatgaataaaaatataaattcagtaaatacagtatcatcacaattagaaagtggactaaatgaaagtcacaatgatatggatcaattaaattatgcattgaattcatttaataaaagatttgaaggttttaatgatgaaattgtaactatgaatgaaaaaatctcagcaataagccttatcacgcaaactataagttctattgcagagcaaactaatttacttgcactaaatgcagctattgaatcagcaagagctggagaagcaggacgagggtttagtgtggtgtcagaagaaatacgaaaattatcagaacagacaactgaatcattgcatgaaataagtagagttgttgacgaaattttaaatgaaagtagaattattatagattcaagcaaagatatgaatcttgaaatagaagaacaaaaagaaaaattatatcaaacaataaattcatttaaaaacatgtcggattctattaaggatattataccaaagatagttgaaatacaatcattgtctgatgagaataaattaaagaaaaatgatgttatagattcaatagcaaatgttactgcaatatcagaagaattggctgcaagtacagaagaagtttcagctactgcaagtgaatttaaagaatcaagcatgagaatagacactatatctaaaaaattagaagaattaataggaaaacttttagaagaagctaatgaatttaggatagattaacctatttgtcgctatttatataaagattaataaaaaaattaaagaaagaaaataataaatttgatataatatttataaagaaaaataattccacatatgaagagaggatgatatcatggaaaatttatatgaaaaagttcaagaatcagttaaatatttaaaaagtaagtttacgagagaacctgaaataggaatcatacttggaagtggtttaggagcacttgtagataaatttgaaaataaagaagaaattccatatagcgaaataccaaacttcccagttgtaagtgtagaaggtcataaaggaagtcttcttcttggaactataggtaataaaacagttcttgctatgcaaggaagattccattattatgaaggatacactatgaaggaagtaacataccctatctttgtaatgaagatgctaggaatagaaaaagtaattattacaaatgcatgtggtgggataaatactgaatttgagcctggagatttaatgataattaatgattttatcaatcttactgcaaataatccattaataggttctaatgacgagagatttggaccaagattcccagatatgtcagaaccatataaaaagaatttaatggatttagctaagaatgtagcagacaaaaaaggattaaaatataaagaaggtgtttatgcacactttacaggtccttattatgaaacagcagctgaaataagggcatatggtaaaatgggggcagacgcaatagggatgtctacagtacctgaaactataattggaaattatttaggaatgaaagttcttggaatagcatgtattacgaacatggcaactggaattcaaaagtgtaagcattctcatgcaaatgttgtagatgtagcaaataaagcatcagctaatctttgtgagtgggtttctgatatagtaaaggaaatgtaaactctatatgagtgagaaagggtactataatgttgtatagtatcctttttaaattataatacaaagaaagttatattaaactttgtgtaattaatgaattatttaatgaaaaaaggaagaatatatataatatataggatatttttaataagtatgttaacgattttgcatttattttgaaattttatataaatagcaagtgaaataggagttaatatatgtttattttagcaatcctaagttattaaacttagggagcttttataagaataaaagtattttatataaattaatagatttttaatttaagggggcagatatatgattcttttatgtgcatgtattttgttatcgtgtgtaatagcaaatagattttctaataagtttggtataccagcattattcctttttatggcacttggaatgatgtttggaagtgatggattatttaagatacaatttaataattatcagataaccaacgaagtttgtaatattgcattgatatttataatgttttatggaggttttggaaccaagtgggatattgcaaaacctgttgcagtaaaatctattttactttcaacagtaggtgttgttattacagcttgttgtgtaagtgctttttgtcattacattttacagttagctttgttagacagtatgttaattggtgcagttataagttcaacagatgctgcatcggtattttcaattttaaggtcaaagaatctaagtttaaaagatggaacagcatccatgattgagcttgaaagtggaagtaatgaccctatagcttttatgatgacaatgataattttaagttttataaatggccaaagtagtatttcaggagtaatttccatgctattttcacaagtgacttttggtgcaataattggtgtcgggacagcaattatcggagtttttattttaagaaagttaaaaattgcaactgatggactagaaacaatatttataacggctttaattttaatttcatattccctcagtgattactttgggggaaatggatatctaagtgtttatattactggtattattcttggaaatagcaggataaataataaaataatcttagttcatttttttgacggggtaaccggtcttgctcaaatattaattttcttccttcttggactactagcatttccacacaaaatgccggcagttattatgccatcattactcataggtctttttttaacgtttatagcaagacctatagctgtattttcaatactgttaccatttaaatcatctattaaacagtgtcttctagtatcttgggctggattaagaggagcagcatctatagtttttgcaataatggcaatagctgatggagtacagattcaaagtgacttatatcatattgtttttgtgatttctttgttatcagttggtattcaaggatcacttttaccactggtttcaaaaaaattagatatgatagatgaagaaagtgatgtaaggaagacctttaatgattatcaggaaaaatcatcaattactttaatgagggtattcgtaccaaaaggacatatgtgggaaaacaaaactatagaagaggctaatattccaggggattctctagctcttattataaagagaaatggggaaaatatagttccgagaggaaatacggtaataaaagggaatgacagtataatattgagtataccggaatatgactgtcaagatgatataaaattaagagaaataaaaatagaaaagtataataaatggtgtaataaagccatagaagaaataaatcttccagatgatattctgattactcttataaaaagaggtactgaaaacataattcctagaggaagtacagtaatattagaagatgatatagttgttgtttataattaaaaaaagaaaagcattgtaaataaaaaagatttatgtagaaatttgttctatataaatctttttttattgaataaaatcaaatagtagtctataatttagtaacaataataaatatgattataggttttggttagtataagtctaattaaattaaaagggaaagcagttaaagtctgctacagcccccgctactgtaatggagtactgtctcaaataaccactggaatttaattctgggaagggtgagtgttcaggttgataccaaagtcaggagacctgcctataaaattttgactattaccttcggtgggaaggcagatggcagagtatgaagaataattaatgtataagtaattaaatgaattttgaatttgctatatcttttattctctagtttgttatggcttccttttatcagatggtaaaaggatttttttatgagtgaaagttgaggaataataatgaaaaaagcgatattagttgtgagttttggaacaagtcatgtagatgcactgaaaaattcaattgaaaaaattgaaataaaaataaagaatgaatttaaagaatatgatgtgtttagagcatttacagctcatatgataattaaaaagcttaaggaaagagatggattaaacattttaaaaccagaagaggctttagagaagcttaaattacaaggatacgaagaagttataattcagccacttcatataattccaggagaagaatttgattacataaagggaatagccgaaagacataatcaagattttaaaactataaaagtagggcgtcctatatttttttatcaaggaatagaagaagttccacaagattatactttatttatagaaagtataaaggaaataatcgaaaatgaagaaagtgtagttttatttggtcacggaacagctcatgcatctaatgcagtatatgggatgcttcagactgtgttagaagatgaaggatatgaaaatgtgtttgttgctacagtagaaggatacccaagcatagagagtgcgctgagacgaatgaaaaaaaaatcaataaagaaaactaaattagtgcctttattacttgttgcaggagatcatgctaaaaatgatatggcatcagatgaggatgattctttaaaaagtatattacaaagagaaggaatagaagtaagtcttcatttacatggattgggcgaggttgataaatttgatgaattatatataaatagaatttatgatacgattgaagatagatattcaaatttaggaaagacgaaaaaattgagaaaaaataaatagattgttaatttagttgagagattatctctcaacttttaattaaaataattggtggtgttttaatgaagtcaataattataggttctgacgctagtggaggaggaaaaactacatttactcttggacttatgaaagcacttaaaaatagagagctcagtgttcagggatataaagtaggaccagattatatcgaccctgcatttcataaggaagttaccaacatagaatcaagaaatttggatgttcatctcatgggaaaagaaggtgtaatctacagttataaaaaaggatgcggtgatgtaggtataattgaaggtgtaatgggtttgtatgatggaataggggcaggagaggaagcttcaacatatgatatttcaaaaattttaagtgacatgcctattatacttgtactttctccaaaaggtcagagttcaactatatgtgctgtgataaaaggtttaaaggattataaaaatgctaatattgcaggaattgttcttaattcagtaagtgaaaaatattataatttattaaaatattcaattgagaaaaattgtaatataaaggtttttggctatattcctaagaatgatgaaataagtctaagcagtagacacttaggccttgttcaaagtatggaagtattaaatttaaatgataaaatagagttatgtggaaaaatggtagagcaatatgtaaatgtagatgaaatcataaattctatgaaagaatttaaatgcaataatgataataatacatattctcaattaaacttaaaggataaaaatttaagaataggtatagcaaaagataaagcatttagcttttattataaagataatatagagatccttgaacaaattggagaaataatttattttagtccaatgaaagataagagtattccagaaaatttagattttctatatttaggaggggggtatccagaagtttttaggaaagagctcacaagtaatgaaaccatgagaagcagcataaagacagctttaaataatgggcttagatgttatgcagaatgtggaggatttatgtatctcacagaagaaattgaaggagatgcgatgattggtttttttcaaggaaagagttttatgacaaaaaggcttcaacgttttggatactgtagagtaaaagtagatgaaaaagtatttggacatgaaatagaaataaatgcacatgaatttcataaatcatgtgtagaaagcaatgaaaagacagtttatacagttgagaagaaacaatataacaatgaattgatatcatggaattgtggatatgctaaaaaaaatacagtagcaggatatgctcatattaatttccttggaaatattgattttcttaaatctgtaataggatataatattatataagaattataattaatataggaaagatgtgaaaaaatgagttatttaaagaatcccatgggaatagaagaaaagagctttgaaataattggagaagaaatgggagaacattctttttctgatgaagaacttcttatagtaaagaggacaatacatacaacggcagattttgaatataaggatttagttgaaataagtgagaactcaatagaaacagctaaaaatttatttataaatggtgctacaatatatacagatacaaatatggctcttaatggaattaataaaatagctttatctaaaacaaatagtaaagttatatgttatgtaaatgagccacaagttcatgaagaagcaaaaactaaaaatataacaagaagtatggctgcagtagaaaaagcatgtgaagataatgttgatatttttgtatttggaaatgctcctactgcattatttagattaaaggaacttataaaagaaggaagagctaaccctaaattaatagtagcagtaccagttggatttgttggagctgctgaaagtaaagaaaatatggatgaactgaatataccatacataagagttaaaggaagaaaaggtggcagtactgttgcagcagctattgtaaatgctttaatgtatatggtagtaaaaagataaaatatataatatggtataaattaacattaaaataatacagatttaacatttaatgaatatacttagtaataagagataaaaatctaatttcattaagggaagtgtaatgatggaatacaggatgctaagtttaaaagaaaaattaaaagatggattaaatgttatctattctaaactgacaccattattagataatggaacaatagaaactcttaaaagaggcggttattcctgtgaaaaatttaatgcaggaaaataaaagaaaagaattaaaatttgtattatagcaaatacttatatttgagtgtaccgtattattcagaaatgaatttgcggtatttttttattatatactaatgtatatttaaattgacatgtaatgctccttgtgtatgcttccagtggcaaattgtcaattgatgttgaaatcattatatgatttctagattataattgcaaagttcatagtgcagaatatatatgtcatttatataagtataaggagagacgtatgtttgaaatgtatgtagatagtgatggaaaaaaactgagatgtggttatacaacaggttcatgcagtgcaggtgcagcaaaagcagctacgatgattttatttaatattgatgaagttttaaatgatatagagataacatctccaaaaggaataaagataagaatgccagtatcacatattaatagaggtgatgagtgggtagaatgcagtataattaaatttagtggtgatgatcctgatataacaaatggaattgagattaaagcaaaggttagaaggataaatgaaaatgaagatatagttcacactctttttgattatgatgatattgaaaatggtgaaagtatatatttaaaaggtggaaaaggtattggaaccgtaacaaaagatggattatttgtacctaaaggagaatgtgcaataaaccctgtgccaaggaaaatgataagagaagaggtattaagtgtacttccaaatggtgaaagagttgaagttattatttcaataccacaaggtgaagaaatagctaaaaaaacatttaatccaagacttggaatagaaggaggcatttcggttttagggacaacaggtatagtttatcctatgtcagaagatgcacttaaagcatcaataaagcttgaaataaatcaaaggtccttaagcaataaaagacttgttttaacttttggaaatttaggtgagaaatattgcaaaaaacttggatttaatgaagatgaaatagtgatatgttctaattatataggatttgccctagagtgttgtgtttcatgtaagattaatcatgtaattcttattggacatataggtaagatgagtaaaattgcttatggatgttttaatacacatagtagaattaatggtgtacgtcttgaagtattcgcattagaacttgcgcttttaggatatgatctttctctcataaataaaattttagaacaaaaaacatgtgaaggtgcagtgaaatatcttggtgatggatatgaaagactttatgaaaatataggtaaaaaaataattgataaaatgaatcagtatgtgtatgaagagatttctattgatgcagttatgtattatggtgcatctgaaccagtacttttatgggattccagggaggattaagaatgatatatatagtaggaataggaccaggacatccagattatatattaccaaaggcagttaaagtaatggaacaatgtgatcttataataggctttaaaagagcaattgattcattagaatttatacccacagaaaaagtatatatgaataaattatccgatcttgataagtatatatgtaataataaaatttatgaagaatatcaaaatgataatgatgcagaaaatagtatcaaaaaaattgcagttatagcatcgggagatccaactttttatggtataacaaattatataaaagttaagtcaaaagaagaacttgaaattataccaggtataagttcatttcaatatttaacatctaaggttaagcttccttggaacaatgcatatcttggcagtcttcatgggagaaaggatgaatttcttactaaggtaaatgagcatgaagtaagtatatggcttacagataaatataatactccaagtgtattatgtaagactctttatgaagaaaagatagaatgcagtgtggtcattggtgaaaatttatcttatgatgatgaagtaataaatatgggagagccagtggaatttacagataaaaattttagtgatttaaatgtatttgtagtacataagacattatcaaaaaaataacgagtcagcccgcaggcatatttggatttgatatgtccttttatatgttatatgcctaagaaataaaaagattttaatgtttttaggaggaaaagtttgaaatttattaaagatgaagaattcatacgtggaaaatgtccaatgactaaagaagaaatacgtatgctttcaataagtaaaatgaatttaaatagtaattcaatagttttagatgtaggaagcggtactggaagtattacagttcaaagtgcaataatatgtccttctggggtagtatattcaatagaaaaagaagaagaggcgtacaacgtaactaagagtaatattcataagtttaaatgcagtaatgtagaacttataaaaaatgatgcagatactgccctttctgaatttgataataaaaatttaaagttcgattcaatatttataggtggaagttcaggcaagcttaaagaaataataagcaagtgtgataaattattaaaagatgatggaacaatcgttatgaatttcataacacttgataatgcatataagtcaattgaaattcttaaagaattgaattatagaattgatatatcactaattaatgtgagcaaaaacagaggaaatacattgatgatgattgcattgaatcctatatatataattcaatgtttaaaatgttaaataattgtataagttagaaatagaggagagaaaataaattatggcaacattatacggaataggggtaggacctggagataaggaactattaacagttaaggcagtaaaaacaattgagaaatgtgatgttatagttgcacctagtgcagaagaaggtggagatagtattgcacttgaaacagcaagagaatacataaagcctgatacggaaattgtaataaagcactttccgatggggaaaaaagacagaattataaaagctttagaagcctatgaatttatagaatcaaagcttaaggaaggtaaaaatgttgcttttttaacaataggggatccttatgtctatagtacttatagccatatgcttaatcatcttagagacgatggttttgaggtaaaaacaattccaggaataacttcattttgtgcggcagcaagtcttgtagatagaactcttgtagtaggaaacgaaaatcttgtagttatgccagcaagcaaagtaaaagaaataactgatgaaaaatttattgttgtaatgaaagtttataaaaaagaagaagaagttttagatatacttgaagaaaaaggtttcgattatgtttatgcaagcagagtaggaagagaaggccagcttgtattaacagatagagaggaaatacttaaagtaagggattatatgtcactaataatagcaagcaagaattagttaactgtaaactgaaaagaaagggtgtttaaaaatgatttattttataggagcaggtccaggggcagtagatttaattactgtaagaggaagagatttattagaaagggcagaagttgtaatatatgctggttcattagtttctaaggaacatcttgaatactgcagaccagatgcaaagatatataattcagcaggaatgactcttgaagatgttatggaagttatgactatggaagagcagatgggaaagacagttgttagattacatactggagatcctagcatttatggagctataagggaacaaatggttgaactggatagagtaggaatacaatatgaggttgttcctggtgttagttcatttactggtgcagcagcagcaataaatagagagtttactcttccaggcgttactcagactgttattttaacaagagtagaaggaaggactcccgtaccagaaacagaagatttagaaaaattagcatcaataggtgcatctatggcaattttcttgtctgtttcaatgatcgataaagttgtagaaaaacttaaaaagggatataaaaagaatgttgcaatagcagtagttgaacgagcaacatgggatgatgaaagaattataataggtcatttagatgacattgcacaaaaggttaaggaaaataatataactaaatgtgctcaaatattagttggagattttattgatagtgactttgaaaaaagcttactatacgataaaagtttttctcatatgtttagagatgcagaggataagaaataatgataagcataatctgtccatctccaaaaggcagtgatattgcatttaaacttcaaaaaagtttaaatgcaaatctttatataaagggaaaaatagaagataaggagtacgataaaatcaaggatgctgaagtatctttatctacaaatcgtactatttatagattttatgaaaattttaagctaaaggatattacagaagaaacatttaaaagttcagatagtattatttttatatcatcaactgggattgcagtaagggcagtatcatcttttattgtatcaaaagatgtagatccaggagttgttgttgttgatttatcatcaaaatatgcaataagtcttttaagtggacatcttggaggcagtaatgaacttacattagaggtaagcagaatactaaactgtcatccaataataactacagcaacagatacaatgaatattaaagcacctgatataattgcaaaaaatcataacctgattatagatgaccttaaaaaggcaaaatgtatagcagcgcttcttgtagatggaaaagaagttggtataaaggatgaatatggtattattgacataacaaagggatatagaaaacttagccagctagaagaaaattctatatggataacaaacaaaattaattatgaagatacaggattggattttactaaagttttaaaacttataaaaagagatatagtgcttgggattggatgtcgaagaaatactccatatgaaaaaattaaagaatttgttttggatagcttaagaaaatataattatgattttagagcagtgaataagattgtatcagtggatttgaaacaagatgaagatggaataattaaattagcagaaaattttgagtgtccatttataacttataaaagggaagaaataaagcttgtggaagataaatatgaaaagagtgaatttgtatttaaaactttaggtgtatattcagtgtgtgagccgtgtgttgatttgagcggtgctgagatagtaataagtaaaattaaacatgaaggaatgacacttgcaataggaatattaaaaagctaatgataagaaataatagaaaggtggattagttatgggaaaattaagagtaataggaattggtccgggaagtattgataatatgacactacgagcttatagagcaatagaggacagtgatattattgttggttataataagtatattgatatgataaaagagcttattgttgataaagaagtatattcaacaggaatgatgggagaagaagcaaggtgtaaggaagcattaaatttatcaaaagataaaaatgtagcgttaataagtactggtgattctggaatatatggaatggcaggtcttattttagaaatgaaaggtgaagaagaagttgaaataatcccaggaataacagcatcaagttcagcaggatcagttttaggagcaccactaatgcatgataactgtaatataagtttaagtgatttaatgactccctatgaagaaataaaaaatagagttaaagcagcagcagagagtgattttataatttccttatataatcctaaaagtaaaggaagaccacattatttaaaagaatgcattgatataataaaagagtttagggaagatacaactccaattgcagtagtaaaacatgcacttagagaaggacaggaagttacaatgacaacaataggagaattcaatgatgaaatagttgatatgatgtctattgtaataataggaaataccaaaagtttttataaaaatggaagctttataacaccaagaggatataatgataaaaagagagataagatcaaaagataatttaaatgtctatatagtaacgatttaattggagataggaaatgataggatttatactaggaacatctgaaggcaaaaagatattatcattaataaataaacatactgataatattgcagttagtacagccacaagctatggaggagaattacttcagaattataagataaggaatttaaatacaaagcctttaaataaaaatgaacttttgacatggattaaagataataatataaaagtacttgttgatggctcacatccatatgcacaggaagttacacaaaatgcaattgaatgtgcagaaaaacttcatattacatacataagatatgaaagattaggtgtattggaagctatagagtcagatcatattgtaagggtaaaaaattacgatgaagcaatagaatattttaaacttcttgatgggaatatattgaatactacaggtggaaataatgcagccagatttgtagatattgactttgaacatagaattattcatagaatacttccatcagtacaagtgctttcaaggttacttgagagtgggataaaggtaaaagatatagtagcaatgcaggggccaatatcatgtgaattggaaatgggatttataaaacaatttgatataaaaggtttattaacgaaagatagtggtgtagagggtggatgtcttgagaaatttaaggctgtaaaaaatttaaacataaagttaatagtaatagaaaagcctaaatttacttataatattcaattcaatgatccgaaaacattggtagattatattgcagaaaaatatattggattgctttagaaatttatatgttaacttattaaagtttgaaagaaagactataattttaaaatttgataataaattagacctttattaaaataaagagaaaggaaaagagtatataagtttttattaagtaaagtatagaaattcatatgcttttatatctaaatggaattaacaataggatttattttggatttattaattggagatcctaacaatccatttcatccagtaagaggaattggattgttagcttctaaattagaaactatttttagaaaacttttaaaaaattctttaaagattgctggattgattgtgtggatgattacaattattttaacatttgcaattacatatggaattatttttgtatgtatgaaaataaataaatatttaggcataattgttcagggaataattatttatttttgtatatcagctaagggattggttgtagaaggatataaagttataaaatatttaaatgaaggtaatattgagaagtcaagaaaacagctttcatacattgttggaagggatacagaaagtcttgattcaaagggaataacaagagctgttattgaaactatcgctgaaaatatgagcgatggagttattgctccaatattatttgcaggaatttttggagctgcaggatcaatggcatacaaggctgtaaataccatggattcaatgtttggatataaaaatgagaaatatattaaatttggatattttccagcaaaacttgatgacttgtttaactatataccagcaagggttactggaatattgataataatatcatcgttttttcttaagagggattataaaaatagttttaagatatataaaagagatagatataatcacacaagccccaatagtgcacatcctgaggctgctatggcaggagcgcttgatatacagcttggaggagcaaactattattttgggaaaattgtagagaagcctgttattggtgataaaataaaggaaatagaaattaatgatgtaaaaaagacagcagaaattttatatttatcggcagttatggggtttatattaatggtaattattaaatttataatatacagaatatagaaatacatatttttgacctataaagtgaaacttgataggtcagaaattatatttaaggaaaaattggaggagattagtttggctaactttggacatggtggaaatgttaaagaaatgggcaggaattacaatatggattggaaacaaataattgatttttctgctaatataaatccattaggcatgcctaaaagtgtaaaagattctattaaagaaaatttggaagagatagagaaatatcctgatatttcttattatgaattaaaacaagctgttagtgagtatgaaaataaaaaattagatagagctgatattatttctagggataatttgattttaggaaatggagcagcagaagttatatatagtgttgtaagagctattaatccagataagacaatgattcttgcaccaacattctctgagtatgaagaagctgtatcatccatttcaaaagaaattgttatatataatttgaaggaagatgatgattttgcattaacagacagtattttaaaagaaataaatgatgatattaatatgatttttatatgtaatcctaataatccaacaggttcaatagtctctaaggaacttctaataaagatattaaaacattcaaaacttacaaatacatttgttgttgtggatgaatcttttctggattttattgatgatgatttttcgattattccttgcatagaagaatataaaaatttaatcgtaataaaatcacttacaaagttttttgcattacctggcttgagaataggatatggactaagtagtaataaggagctttgtgaaaaaatctcaaaaatgtttcctgcatggaatataaatattttagctgacatttcagcaagggtatgcttaaaagatgaaaaatatattgctgaaacaattgattttatggaaaaagaacgaatttacttgtataatgaactaaagaaagttaattatttgaaagtatatgagcctagtgttaattttatatttttcaaaataaataaatctatggaattaaaaaaagagttactaaaaagaaacatacttatacgaagctgcagtaactatcgtggtttagatgagagatattttagaattgctgtaaaaggtcatgaagaaaatatcaagataataaacgcattaaattcaataataaatctataaaagacaataagaattatgtaatttacacttgtgaagaaattttaaatttaaacactaattaattgaactagtggaaggggtatattatgaaaaagaaaagcatcatgtttttaggtacagcatcttctgttggaaagagcactttagcagcggcattatgcagaactttgaaaaataagggttttaatgtagctccttttaaagcacttaatatttctctaaattcttatgtgacaaaagagggactggaaatggggagagcgcaggttgttcaagcagaggcatgtaaaattgaaccagatgtgttaatgaatccagttttattgaaaccgggtggaggatgtactcaggtaatagtagagggaaaagtttattgcaatattgaaccttataagtataaggagttaaataaaaaattaaaagcacgtgttaaagcttcttatgaaaaacttgaaaaagattatgatgtaatagttttagaaggttcaggaagttgtgcagaaattaatttacaaaatacagatatatctaacatggcaatggctaatatttcagactctcctgttattttagtagcagacattgatagaggaggagtatttgcatcagtagtaggtacacttcaattattgcaggaaaaggatcgagatagagtaaagggtgtcattattaataaattcagaggcaataaaaaaatgtttgaagatggaaaaaaacaactagaagaaataataaagattcctgtactaggggtaatgccttatgaaaagtttgatattgaagatgaagatagtgtaaccgaaaaaattaaaaatgaagagcaagaaggaaaattggatatagcagtaattagactttcacatatgtctaattttactgattttactatgctagatagaatatgtggagttaatgtgagatatgtaagggaaccagaagaattaagaaatccagatataataataattcctggaactaagaatactattgatgatttaagagcaataaaagaaaacaagctatttaataagattaaagaagtaaaggaaaacggagtacctatacttggaatctgtggcggatatcagatgcttggttctgttgttcttgataaacttggtgttgaaggtgatataagccaagaagaaggctttggtttcttggatataaaaacaagatttaatgaggctaaaataacaaagcaaacacatgctgatatattatgtgatttaagagatataaaatccataaaaggacatattgtaagtggctatgaaattcataatggaataagtaaaattggaaaaaaagcagttccatttattaaggatactgatggtgtagtaataggagtatgtaatgaagaaagaaccatagctggaacatatcttcatggaatatttgattcagaggattttataaattcctttgtaagaggtcttaaaactagtaatgatatttctatatcagaagaaaaacttattgaaagagtaaatgaatataaagaaaaagaatatgacaggcttgctaaaatatttgaagaaaatattgatatggataaaataaataaaattctaaatatagaataattttgtatgtagttatatttacagtattaataaggaaggagagcttgaattgttatgttgacagatactgaagaaagaatgcttcaatatattcaagatcatgcaaatgctaatgttaggggaaaaacattttttagaatgacagatgttttagaagatgcatttcttcttacagaagataaagcttatgaagtttttaaaaatataatgtctcgaaagaatataggaaattcaaaatatgatattattgatgaatatattgatatgttgaaaaaaggatatggatcaattaaggagcaggtagatatattcggtggcgatagatactcaatagtagtgtctactgctgaaaagagaataaaatcttatgagggtggaagcttttttgacgtgcttagagaagtatataatgtaagtgatagtgatttaaatgaacttatattgaaatttatatcttttgcaagctctccaggatttagtataaaattagatgaagaaatgtataataaatttcttcagtcagatttagaagaactcgataaacaatatgaaagatttttaaatttgaataataactaacgggggattttagaatggcttatgataatcaagaattatttaaatatatagagaaaagagcaaaatacaatgttgaaaataaaaagtttttcagaaatacagatatattaagagctgcatttggtgtatctgaagataaagcttatgaaataataaaagatatgatggcaagcggaaaagttgtaccaaatacgaaggaatcacttattgatgaatatatgaatatgcttggaaatggatatatgacattaagtgaacagtatagtttaattggaggagataaactttctttgataaaaaaagaagcagagagaagaaaagaaaagtttaataaaggaactatatgtgatatgctgcaaatagtttttaatgttgataataaagatctagaggatattattataaaatatttaaaaacagtagaatccacagatttttcatttaaattcacagaagaaagcttttatgaatttcttgaaaaggatatgaatgaacttgataaacaagcagatagatttagaatataatttttaaaaatagctggtatcaacttagttgataccagctattttgcctaatcaagtataaaatctaaaaatatatattagttaataggaatattggttaagtaaaatgaaatacatggattctgtgtttatttcaatactctaacaatagctagtattataagcaatacacctgaaagccatgataattccaaatgaagtttttcagagaatttttgacctaaaaatacaccgattgaaactgctgaaactcctattaaaaaacataataccaaggtttgaacataatttatgttgcataaactagaaccaaaaccaacagcaagactatctaaggatagagctaaagctaaataaaacgattctttagaattaagagatttagatttatcaaaatcggcttttgtttcgtcagcatatacttgaagaacgaatttaaaatcaaataatttaaaggttaaaggataatcacattttgtttttttagaaatatatgctttaaacaaatattcgaaaagtctataaattccaagagacatcaaaataataaagcctaaaacagctggaagatttccaggaagaaagcttttaaaaagagaaccgataaataatgaacacgccaaagtcgaagtacatactagatttattattataacagattttggtggaatttttatttttgaagttccataagctatactggcaacgaatgaatctatacataaagatgatacaagcaataatgactcaagcataaatcttacctcacatttcctatatacataatcataatatgaataaaaactacaattagttacacaaatcgtaaatatcatgtaagctactgtaatatattttttatttaagtagttatattaagaaaatgtgattcatggtatacttaaatagtaaaaatgaaatataaattttaaatataaataagtatttggcgtatggaggagaaaaatgtacaaattaattgcactagatatggatggaacattacttacatctgaaaagaaaatatctgaaaaaactaaatcagtattaaaagaagcagaaagaaaaggagtaaaagttgttttagcgtcaggtagaccactaactggaattacaagatatttagaagaattagacctttttaaaggcgatgattatgtattaagcttcaatggtggtatcgttattaatagtaaaacagaggaaattataacaagtagcttattaaagggatctgatcttaaagaaatatttaagacagctaaagaacttgatattaatatacatgccttttcagtaaaggaaggattaataactcctaaaatgagtcagtatactcagcatgaatgtgatataaatgggattaaagcaacaataaaagactttaatgaaattgaagatgatgaagatattgtaaaagttatgatgattgatccacaggaaaaattagatgaagctataaagaaacttccaaaagatttatatgaaaaatacagtgtgtttaaaagtgcacctttctttttagaatttacaaataaagaagtagataaaggtaagggtctaaaaaaattaggagaatatttaggaatcaagcaagatgaaattatagcatgtggagatgctggaaatgatttatctatggttgagtatgcaggattaggagttgctatggaaaatgcaactgatgatgtgaaaaaagcagctaattatattactctttctaatgatgaagatggtattgtgcatgtggttgaaaagtttattttaaactaaaacagtatattataataaagcatccatgaaaatggatgcttatttattttgatcaaaaataagtttaaatatcctaatgatataaaatactaatactatttatactataactaagttgtatagtatacaaataagctataatcaacataatatagatatactttttattttaaaaataggaggaatatattaatgaaagtagttgtaataggatgtactcatgcaggaacagcagcaattgttaaattaaaggaattacattcagattatgaagttgttgtatatgagaaaaatgataatatttctttcctttcatgtggaatagcattaagtgttggtggtgtagttacacagccagaaaaattattttataattcgccagaaaatttagctagtatgggtgtcaaaacaaatatgaatcatgaagtgacagatataaattttgatgagaaaaaaataaaagtgaaaattgtaggtagtaatgaagagtttgaagataattatgataaattaatattaacttgtggatcatggcctgttgtacctaaatttgaaggtggagatcttggaaatattttattatgtaaaaattatgatcatgcaaaagaaataatagagaaaagtaacaattctaaaaaagtaattgttataggtggcggttatatcggtgttgaattagttgaagcttttcaaatgaaaggtaaagaagtaacattaatagatactgcagaaagaattatggcaaaatatctagataaagaatttacagatatagcagaaaatgagtttgaaagtcatgggattaatcttgtacttggagagaaggtacagaaatttaaaggtaatggactggtatcacatgtagtaactgataaaaatgaatatgaatgtgatcttgttatcttatgtataggctttgtacctaacaatactcttgtaaaaggaaagcttgaaacattagataatggagctattttaatagatgagtatatgagaacaagtaaagaaaatgtatttgcagctggtgattgttgtagtgttatttataatccagccgaagatattagatatataccactggcaactaatgcagtaagaatgggcacattaattgctcttaatatagaagaaccaaagataaaatatatggggactcaggggacatcaggaataaagatatatgaacagtgtatagcatctacaggtcttacagaggaaagcgcaagattgactacaaattacaatattgattcagtattgataacagataattatagaccagaatttatgccgacttatgaacctgcaacattaaaaatagtatttgataaggattctagaagaatacttggaggtcagataatttcaaaaattgatttaacacaatttatgaatactttatctgttgttatacaaaataaaatgacaattgaagaactttctatgacagatttcttttttcagccacattttaacaagccttggagtttgttaaatattgctgcattacaaggaataaaatagcttgtatttaataaataatggatatttttacttcaatatagaggtatccattatttattttttatattccataataatttttcttaaaagtaaaaaaagatttatttaatctattcaaatttactacaagtacacgaatataataattagaagaggaaaagctttaaaacttttgcttcaaaaaataaatccaaatgtttcaaatgaaaaatgattaaaagataagaacaaaagcaggatctaaagaaataaacaagtaagagtttagtggaattatactagaaataaatttcggtaaattaaagaaaatataattttaattatataatactctaacttatggtttaactaaaattacaaattattatattattcctgaattttggaacatatctaaagattatatatgagctaatttaaaaatgcaaaaacacgtataaaaaataagttgtagatttatgggttgataaataatataagcattttgagataaatggtgtacatataattatttagacatttgggaaaatttataattgtatcattttagggggaatagcagctatgaggctggttccgattgaaaaagtacgacctaatactgtattaggaaaaactatatatgacatagatggaaggcttcttttaagagcaggagtagttttaagagaaaatactataacaaaaataaaagaaataaacattctatctatatacatagttgataaatatagcaacgaggaaattgaagatatcataaagcctgaaataaggcagaaagctataataactataaaagaagcattttcaaacataggaagacttaataatggaaattcatttagaaatagtgagcaggactatacatggcaggaacaaagctatttttataatataggaaagatggcagaaaatataatagaggatatattaagtcataaagatttagttttagcattagttgatattagaagtatgaataattatatgtattctcattgtgttaatgttgcagttatttcgttaactataggaatcgctatgaagttttcaaagaaaaaattagaagcattatgtataggagcacttatacatgatataggaaaatcacttattcctaaaagattgatggaaaaggaaacacaatttacagaaagtgaaattgaaattctaaatcatcatccaagacttggatataaatatttatcaagtacatataatattaatagtttgagcaaacttattgttttgcagcatcatgaacgtccagatggacttggatttccagatagacttactgatgaaaacataattgatttaagtaaaattgtgagtattgcagatgcatatgacaatttatctacagatcttccaggcaaaagagcaatgtttccaagtgatgttttagaatatttaatgtcaaatgcaggaacgatgtttgattataatttgataagtgtattttgtagaataataataccttttccaaaaggaactgtagtaaggttaagtacagaagaaatagcaagagttgaagaaactattcctaattttcctcttagaccaatattaagaataattagtggaccaagggagagtaggattggcaataagatttcgttattagaggagttgtctatagttattacagagatagtgtatgatgtggaataatagatgagttattggacttttatatccaataactcatctattattttattctattatttttataaacttaaaatttgttacatcaaataaacctttatcagttatttttattgaaggaataactggaagtgagagaaatgaaagtgttaaaaatgggttaaagttaatgttgggtgctactatttttatactattgtgaagactttctagctcaaaatctatttcactataagatcttgatgtcattaatccagcaatttcaagttttatggaagaaagaattttttcattttgaactacaattattccaccgccaattttttttagttcttgtacagcaaacaacatatcattatcattagtaccagctactataagattatgagaatcatgggcgatagttgtagcaattgctccacattttagaccaagtccttttaatattccgagacctatatttcccgttgctttatgtctttcaattactgctattttcacaagatcattttttaagtaggattcaaaattgaaagtaccagaagtatttacgttctgattatataaatcactttgattgtactgtaaatgttttgtttcaagcttgtttggtataatttcaattatatttattttttttgcagaatcattagtaagtgaaactttaaaactatctttagataaaataggaatgtttattgaatttgttattttaagatttttaagggtgttttttattggtatactagttagcagtttacttttatctactacgagcaaaccttttttataaactctatttattttaaatgaagttaaatcatctaatataataaagtctgcaatgtatccaggggcaatagcacctttattttttatattgtataaggaagaagtgttgattgatgccattgatatggctgtttcaggctttaaaccaaagtttatagcttcaataatggaagtgttgattgaaccatttttcattaaatcatcaatatgtttatcatcggtgcataatgagaagcgtgaactgttactttcattaacagcaggaagtaattctttaagattcttcgctacagtgccttctcttattaacacatgcatacctcttcggattttttcaagggcttcttctttagaaatacactcatgatctgtagatatatttgcgcatctataagaatttaccatcataggtgtaagaccagctccatgtccatcaattattttattattactaatggcatcataaagtttattaataatatcttcactacagttaattactcctggataattcataacttctgcaagtcctagtattctttcgtttttatatagagattctaaatcttttgcatttaatacagctccagaattttcgaattctgttcctggaacacatgaaggaagcataaaatacatatcaaatgggatattttcagaagagtcaagcatgaatttaataccatcaagaccaagtacattagcgatttcgtgtggatctgcaataacagaagtaatgccatttaaaagagcggctttataatattcagctggagaggttaagcttgattcaatgtgacaatgagcatctataagaccaggacatatatatttattcgttccatcaaaagtttccgttccttcatagtctccaataccaactatatacccattttttatacctatagaattaataaaggtatttttattaaatacatcaactatatttatatttttaatcaccaagtcacattttattgatttggtagatgctttaatttgttcaatgaaagtttggtttgtcatgataaaatcctcctataactatagaatactttaacagacagttagtccataaaataatgttatatgttatgttttatgagctcattttatacttatcatcatatatcattgtattcctaaataaattattttttctattatagtaaacatcaataggtatgtcaaaaagtaaaaaggttttcaatcataaaattattaataatataaaaaagcattagattgacttggaaatagtcaatctaatgctattatttattgtaatctgttaaatgaactcaatgcatgttggtgaataaatttcatgagaattcataaatgtcaggcttccagttgatggaccaatagaaaatacagatatattatttgatttttcatttgcgacaaaaagataactaccagttggatctatttgaaaatctcttggagaatcaccttgacatgatacagtttctaacaattttagttttccatctgtagaattaattgaaaataagcttatagaattatttcctctatcagatgtataaaggaattttttatttggatgaattcttattgcagctccacttttgttaccatcatagtttaatggcagagtacttattacttgaattttttcaaagatattattattagatggtttgtatctaagtacaaaaatctcggatgttaattcacttaaaacatatatgtattttgaattaacataagtaatatgtcttggacctgttccctttgggaaatgatagcttaattctgatttttctgatagtgtaccattgagtaactcataaacagctaatttatcaatacctaattgagtagagattatatattttttatcaaaagtaaacatagaacagtgaaaatgaggattttcaattaatttatcatcagaatcagattgtgtatgcgttcctatagatgggtaatttagtatgataccttctaaagtattgtaaactatcatcttattttcatgataatttgatgaaattactacttgattatcattatttgtacttatatgacagggttgtttttcttcagaaagattataatttattagatttagcttatcttgttcctgccagtacttaaatgatattacccccgctttatcatttattttacaagtagaataaagtatgtgtctttcggtatcaattgcgagataagttggattttctacttcataagcaagatccactctctctatttcttttgagtttttgttaaagtttatgcgatatatccctttacttttactattggtatacgtacccacataagctgttattatattttgatgtaataccataatgtgtgccccctttatgtatgtatataaagtagtataacataaatagaaaatatagtgatttattcatattagttactatttaagtgaaattaaaaaatgattaaaaaaatataataaataaagtaaattattaaataaatattaataataatattaaaatattattatagagtataaaaaattatttgataaaaaataaaaggcaggaatatattgaatcgtttagtatttaaatttatagcacatataaatttaaatactaaaggattgtgattaaacattaagttgatatatatacaaattttgatatataatgataaataatatatcaaaaagcaataagcaaaataatgaaaggggagttaggaatgccaataaaaattcctagggaattaccagcatttaaagttttaagtgatgataatatattcgtaatgaataatgaaagagcaaacacgcaggatataaggccacttaagatagcaattcttaatttaatgcctaaaaagatagtaacagaaaatcagattttacgttacctgtccaatacacctcttcaggttgagataagattgattcagacaaagagttacacatctcataacacgcctttagaacatttagagaaattttatagttatttcgatgaaataaaacatgagaggtttgatggtcttattataacaggtgcaccagtggaacaaatggaatttgaagatgtgacttactggaatgaattgactaatattatggaatggagtaatacaaatgtattttctacacttcatatatgctggggggctcaagcaggtttatattatcatcattcagtacctaagtatgatttagatcaaaagatgtttggggtattttcacattgggttaatgatgaaaaagcagatcttacaagaggattaagtgatgtatttaatgcaccacattcaagacatacagaggttaaaagagaggatatagtaaaagtagaagatcttgaaatattatcagaatcagaagaagcaggggttttcatagtagcaacacaagatagaagaaaagtttatataactgggcatcttgaatatgatagaaacactcttaaagatgaatatttaagagacttagaaaaaggcgataatatagcaatgccaaaaaattattttaaaaataatgatccaaatgaaaagccaagccaaacatggagaggaagcgcaaatatagtttttggaaactggcttaattattgtgtttatcagaatactccatatgatcttaatactttataaaatacataacagctgtatactttatttaattaagtatacagctgttattaattcaataataaatataaagggaactcctaatgtgaattttatatgttttgttttatgtctgaaaatatgcattccggcaaacattccaatagatcctccgattaatgatacaaacattaatgttttctcagggattctccattctttgtgaacagcacggcttttatcaataaacattattagaaatccacagatattaattactattaaatagagaaatattattttatacatataattactccctcaagtattaaacttaaagtaattatatcataaatttaagattcttatccaccaagggtaacatcttgtttatcataccacgataaagcaccataaaaatcctcttctttaaatgaaggccagtagttattaataatataaaaatcagaataaacagattgagctggaagaaaaccacttaatcttctacgtccaccccatcttattattaaatcaattcttgaaatgtctttagaatgtaaatatggaattataccacttttagaaagagcaggatttttaagaagatttaaatcccattcccatccatagttaattaaaaagtttacttttattccaccactaccaaatacttttctttcagtatattgtaataattctttagggaagcaagatgaatttgtatttcctaaaactaatatttcacaattttctttggttaaaagttcaactgattcaatacaggctttagtaaaagcttctttttgatcagaaggccttttggtattatctacagtaaaaccgtaaaatgttacttcttcaactttttctttttgacataatttaaacacctgtaatccaggatcgataccatagctgtaccccatatcttttgtcatatcattggatagagcccagcgacgatttccatcagggattattccaatatgttttggcactctcataaatttatccttccttatttataattagtaattcttatatatagtttttccaaatagtataaaaaaatacatataaataaaaattcatgaaaataaaaactttttggcatataaaaacggctgtgaatttaggggaattcacagccgagttaccatttaaccataaggaaaatggctattactatttaataaaggggtaaataataatttttaactactttacaagttttattataagatttgtatgtgtcaggtttatgtcagacatattaaaaaaatcataaaagaggttaaggaattcttaataatattaagaaaaatatcagtaatacataacgtaataagtactataatctagctaaatttaaataatctatatataataggtgttgtcaaagtaataaacataaaaaaggagataattatgattgaagtaaaatataaaaatacagaaaagcagatatgtgatttctctatgtatagggcaacaagttcagaatcatataaaaaaacattaaagaaaaaatctaatttcatgtttctgatatttttagtagctggactaatatacatttttgcaggatttaatatgaaagagcaaggtaagttaccaatgggactaatttttgcaggaatattctttttgtttgctgtacttagtctatttttctttgaaaagtatgctaataaacatgttgcaagaacaattagaaagaatttaaagaaaaagggaaatgtgattgattctaatattaaagtgaaatttgatgggaaagcaataaaggttttaaggggaaaagaaaagtctataataaagactaattcaattattgatgtaattaaattgaataaatgtttatgtattgctgctaaaggggatattggaatagcaataccttttgattcatttaaaaaagaagaagatttgataatgttagaaaagacattaaaaaattatataaagtaggtatgataatattatggttttagtaaagaatttgaaagttgttgaatatataaaaaaagaaagtgttttaataatagcattgtttttagcaattacaacttcatttatatatacacctaagatggagtatatagattttaagacacttatattattattcaatttgatgataatagtaagtgcatttaagaaacttaaatttttagattatatagcagtagcagttgtaaaaaaatgtagtacatataagcatttatcagtagcgttggtatttataactttttttgcatcaatgttagttaccaatgatgttgctcttattacatttgtacctattactatgattataggaagtaagttagatattgatgttttaaagattgttgtttttcaaactttagcagcaaatttaggaagtagtcttacacctatgggaaatcctcaaaatttatttacgtatacatattacaatatatctccaataagattttttcagataacagtaccaattgcactaatgtctatattatttcttattatgcttatatttaaaagtaaaaataaagtaataaatatttcaatagatagggttattataggagatagaaaaaaattaataagctattctatacttttagttataatattgttttcagtatttcatgtaatagattataagttatcatttttattaaccctcctatttatattctttatggatagaaaactattttttgaagttgattattcactacttataacttttataggttttttcatatttgtaggtaatatatctaattccatacaaatacaaaattttatgaaaacaattcttagtggagaatcaaatacatactatgcaggaataataataagtcaatttataagtaatgtgcctgcagctatgcttctatctggatttacagagaattttaatgatttaattcttggagtaaacatagggggaatgggaacgttgatagcatctatggcaagtgtaatatcatataagctttattgtactagtaataatgaaagcagaacaagatatttaagagtatttacgctgtataatattttgggacttgctttgtttactgttctttttaaatttattttatagtctatagtatttttatctttagttcattaactataaatataatatattgattattacatataggtatatacttatgattaatatatatcaaaaagtattggattatatctgatttaatggataaaatatacataaaagaatattagtgaaaagtaaattacataaaatgtgtgtggggggataggtaatatggcagttaatgcaaaaagacaaaaagaactaaaagctttaggttttttattacaaaatgataaggaacattttgcagtaagactacttagtagagcaggaaattttacagtacaggagctaagagacatagctaatcttgcagaaaaatatggacgtggttatgttggtgaaactacaagacttcaagttgaaattccatggattaaggatagcgacgtggaaaaattaattgaagaaataaaagcacttggattaagacatggtggaactggacaaaaaataagacctttagtttcttgtaaaggtacagtatgtttgcatgggaatatagatactcaagaaatctgcaggcagttagaggatagctattttggtacagatacacctcataagtgtaaaatagggattgtagggtgtgcaaataactgtgcaaaagctaacataaatgatattggaataatgggaagaacagttcctgaatttgatgttgataaatgtgttggatgtggactttgtgttaaatcatgcagacaaaaggctcttgaagttgtagatggaaagatagttcataataaggatttatgtgttaactgtggtggatgtgtacgtgcttgtaatttaaaagcagcattacctaaagaaaaaggtgcagaaatttttgttggtggaagatttggaagaggaataagaatcggtgattcattgggaaaaatatttaaagaagaagaaataatacctatggttaataagatcatggattactatagggaagttggtataaaaggtgaaagaatatctactgttatggataggataggaaaagataagtttatagaagaagttttaaatagatagaaaaagtgtacaattcacctataataaaagtgaattgtacattttttaattaaagatttgtattaaatcataagtccatgtagattatgttggatttaaataattattgttatatttttatatgttaattaggatataataaataattgagaaataaattattatataaaatatttcaagaaatttacgtgtacttaataattattatctgctaaactaatcactatgcagatattattatgtagtataataatgtttgctaattatttagattaaattatatgacagaggtgacaaggtgataggattaataggaattaaaagaaatacgcctttagaaatcagagaaagacttacattaaagcctaaaagaattgaaacatatactaataagcttttagaaatatttaaagaagttgtgattttagcaacttgtaacagaacagaaatttattttaatgatttttttaagaaagaagaactattaaaagagatttttgagatttttgattgggattattcgtttagagagtatgtttttattactagaggagaggattcatgcagacatttatttgaggtatgctgtggatttcattcgaaaattataggtgaggatcagatacttgggcaggttaaaaatgcatatgaagttgcacttgaattaaattcagtaaatttagaattacacagattgtttcaggaggctataacatgtggaaaaaaatttagaaatgaagcaaaactttatgatattccagtttcatccgcatcaattgctgtaaatgaaagtataaaaaaagggtgctctagatttatgcttatgggatatggggaagttggacatcttgttatgaagtatttactgtctcataaaacagacattatatatttggttgttagaaatactaatattaaatatgaaatagaagatgaaagagtgcgagtaattacatttgatgagaaaaatagatacatagatgaagttcaaagtataatatcgtgtacatctgcacctcatattgtgttatctaaaaatgatataggtgagtgtggagaaaaactatatatttatgatcttgctgttccaagagatattgatgatgaagtagaaaatatgagcagagtagaagtatataatattgataaagtaagtgcgctcaatgatgaaaataaaaagttaagagtacaaagaatggtagaaaataaatacatattaaagaagtatcttaatgagtttttcgaatggcagaagattagaagtattgcctcggaaataaaaaaaataaaagaagttggtaatgaagtttatagtatgagaagtgttacatttaaaaataaatgtagagataaaagtgatattaaactagcagatacgcttataaaaagtgcttcagatttttatattaatcgggctattaaaattttaaaagaagaaacactaaagggacgtggtgaagaatgtatagagataatagagaaaatattcaggatgaattagaatattcatttatttcacttttttcaaaaaaactccgaataggggttattggaggcggaaaagctggtgcaataaaaatcaatcattttgtaaaaaataattgttatgttgaagttttatcaaaagatttttcaaaggatattttagaactttcaaataatagtgataaccttaaattaatatatagagaatttgattatgaatttttgagagataagcacattataataattgccttagaggataataaaataaaagaacttataaaagaatattgtgataaaaattataagatatatatagattcaacagattttaaagaaggtatggctattgtaccagcagaaagaagtacaaaaactattagttttgctttaaatacaaaaggaggtaatccaaaaggagcagtatgggcagctgataaaataagcaaagtattaagagattatgatgactatatagattttactacaaaagtaagaaataaagctaaaagtattccagaatataaaagtgagattataaaatttatttttacagatgaatttaaaaatgattttgataaaggtgaagaaattaatagtataaagagtagatttccagaagaagttataaataagttattttaatttaaacgtggaggagagttttaatggataaattaatacttgcaacgagaaaaagtagattagcacaagttcagacagaaatagttatggacagtttaaaaaacaagattaataaagagagtgagaagctccttatagttacagaaggtgatagaaagctggatgtgtcgttaaataagataggcggtaaaggactttttgtaaaggatatagaatgtgcactattagaaggaaaagcagatgcagctgttcacagtatgaaagatgtgccatatgaattaagcaatgaatttgaaataacagcaataatagaaagagaagatataagagatgtattaatttcaaaagataatatatcatttagtaaattaagatatggagctaaaattggaacaagtagcataagaagagcagcacagctaaagttattaagaagtgatattgaagtagtgcctattagaggaaatgttcaaacaagacttgcaaaaatggaaagtgaaaatcttgatggaataatactggctgcagctggaattcatagattaaagctagacaacataataacagaatattttgatcctaaggaatttcttccagcagtatctcaaggagcaataggtatagagtgtgtaaaaaacagtgaaaattctaaatactttaaaatgctggataatagtgaagccagaattactgtggaagccgaaagaagttttatgagggaattaaaaggagattgccatagtcttattggggcttatagcgaagtgactggtgatgaattatatatgataggaatatatgatttaaatggagtaatagtacgaaaagatattactggaaaaaaatctaatcatcttgaagtaggcagaaagcttgcagaaaaaatattaaatgaaaaataaaatattaagcaattatgaattaataggagaaatattattatgagtaaagtttatataattggaacaggacctggtgatgaagaattattaacagttaaagcagtaaaatgtttgaaaaagtgtacagctgttttgtatgatagattagtttcaaataatgttttaaattatctcaatgatgattgtatagtttactattgtggaaaagaaccaggatcacattataagacacaggaagaaataaacgaaatgattgtgaaattggctaaagaaggccatatagttggaagagtaaaaggtggagatccttatgtttttggaagaggaggagaagaagttcttgcacttaagcatgaaaatatagattttgaagttattccaggtgttacatcacctatagcagtgctaaattatgcaggaatacctataactcataggggaatagcgcaaagttttcatattattactggaatgtcggctaaaaatcttaatgttaattttaaggctttggctattgaagaaggcactttagtttttatgatgggattgagcaacttagaaaatatagttagtcagcttgttgaaaatggaaaagattcagagacgccatgcggagttgtcatgagaggaacatgcagtaaacaaaaaaaggttattggaactttgaatgatatatcagaaaaagtaagaaaagtaggacttcaatcaccatgtattattgttgttggagaagttgtaaatttacatgatgatttggcttggtatgaaaataaacctctttttggaactaatatatgtgtaacaagatctcaaaagcaaggggttaagttaagagaaaaattgagagatatgggtgctgaagtgacttctataagtgctattgagatagagccttcaccagaaaatcttaatgaatacatggataaattagaagaatatgatcatatagtatttacatctgtaaatagtgtaaatatcttttttgattatttaattaaaaagggatatgatataagaagattaaatgctaaaatttcagcaattggtaaagctacatggaaatcattagaagatagaggtattgtttgtttcgaaaaagcacgtgaatttattggtgaaggattagttgaagttttaaagccacatattaatgaacatgataaaattcttataccttgttcatctattgcaaaagaaaacatagcagaaagtttaaagaaagctggagcagatgttcaaagagtgtttatatacaatacagtaaaaggaatcttaagaaataagagggtttttgatgaagtggatgtagtattctttacaagtccatcaactgtatataatatgattgacatggttggactagatgcggttaaggaaaaacatattattgcaattggagaaaagacaaataaaccacttgtagaatttggaatagatgcagatgtatgtagtgaacattcagaagatggtttcttaaaggaaatagtgtcatttgtaaatgaaccaaataattaaataaacataatcgttaattgataactgttaactgttaattgttaactaaataagctggagggatagtatgttaaaaagaggaagaagactaagagcaagtagttcgatacgagatatggttagagaaacaacactgaactcaaaggactttatttatcctatatttgttgttgaagggaaaaacattaaaaatgaaatatcttctatgccaggaaattatcattattcaatagatagattacctgaagttataaaatctatagaagaagcgaatatagcaggtatcttgctttttggaattcctgaacataaggatgcatgtggaagtgaagcatataatgatgatggaattgtacaacaggctgttagaaagataaaggaattaaataaagatttattggtaataacagatgtgtgtatgtgtgaatatacatctcatggtcactgtggaataattcatggaaatgatgtagataatgatgagactctagaatatcttgataaaatagcagtatctcatgcaaaagctggtgcagatatggttgcgccttctgatatgatggatggaagaataggttccatgagaaaagcattagatgaaaatggatttagaaaagtaagtataatgagctattcagcaaaatactgttcagcattttatggaccatttagagaagcagcagattcagctccacagtttggagacagaaagacttatcagatggatccagctaatagaatggaagctttaagagaaacaaagatggatattgaagaaggatgcgatataataatggttaagccagcactttcttatcttgatgtaataagagaatgcagggataattttgatatgcctcttgcagcatacaatgtaagtggagaatattcaatggttaaggcagctgcaaaagcaggaatgattgatgaagaaagagttatgatggaaatattaacttcaattaagagagctggtgcagatataataataacttatcatgcacttgaagctgcaaaaatattgaataaaaaataaatatagaataaacaatgaggttgtctgaattcttatgtagatgaatattcaggcaatttctgctattataattaaatgtataagttataatacgaaaactttatggattataatggatttcatgaaatagtgaaagtcaaaattttatagttaaactattaataataaatattaaagtattaattttaatggatatatttacataattaggaggaaataaaaatgactaaaaataatcaaatttttactgagtcgcagaaatatatgcctgggggagtaaacagtccagttagatgttttaaaggaatgagtatgaatcctcctataataaagtctggcaatggtgtaatgattcaagatgaagatggaaaagaatatatagattttgttttggcttgggggccattaatccttggacattgtgatgaagatgtagtaaaagcaattcaagaaacaagtagtaaggctttagcttttggagcgccaacaaaacttgaattagatcttggaaagtttatgtgtgaaaatttagataatgttgaaatgataagaatggttaactcaggtacagaagctacaatgagtgcaataaaacttgctagaggatacacaaagagaaacaagatagtcaagtttgcaggatgctatcatgggcattttgatggatttttaattgaagcaggatcaggagtaatgacaaatggtataccaggttctcttggagttcctgaaggagccatagaaaatacattaataggaatatataatgataaaaagcagattactgatctttttgaaaagtatggacatgaaattgcaggggttattatagaacctgtagctggaaatatgggtgtaataaaagcggaagaagattttatgaaaactcttagggaactttgtgataaatatggctctcttttaatatttgatgaagttatgaatggattcagagttgcttttaaaggagcgcaaagcttatttgaaatagagcctgatttagttacatatgcaaagattatgggggaggacttccatgtggcgcatatgcaggacgaagagaaataatggaaaacttatctccattaggaggagtatatcaagcaggtacaatgtcaggaaatccaatagttatggcagcgggtcttgcaacgttgacaaagcttaagaataatttagaatggtatgatcatattgaaaagataggaattatgcttgaaaatggaattaaagaaatttcagataaatataatattccagtcattataaacagagtaggtggtatgtttactgtattctttacagatcttgaagaagtaagatgttatgatgatgttaagacatgtaatgtagagagatttaatagatattttgaacatatgataaataatggcataaatattgcaccatctcaatttgaagcagttttcttaagtgttaaacatgaagaatgccatgtagagaaattcttaaagtgctttgaagaatttgcagttagtgaatcaaattaagtatttaatataattaattttaaaaagttgactacaattaaattatttaatcaatagttatctaaatataaaaatagaatatttaataaaattgaacctataaaatagatacttgtaaaagatagtctatatattataggttcttttattttctatcttagaaaggttaattattaagtttatttttaagataagcatatattaataattataaacaaaaattattgcaatactcacacaacgtttacatgatgctcgttatagtaataatatgattatagaaaaattaaaataatgggggtaaaataatgaacaagaagaaaatattaaagttaacagcagcagcaatggctatgactactgtgggtagcttaaatcaaggaagaattgtaaaagcagttgaaaataatgtacagctatcagaattagatgtaaaagatgaatcactaggaattaagtataaagagacatgtgaagacctaacagagaataatgagaaaatatcttatgaagaaaatgcaatagttagtgaagagcagaaaggcgatgaattagaaaagagtaactttgaaataaaaacacaaacctctacaggttcttctgtattttatgaaaacgattttgaaaacgggggttgcctgatgaagtaaatataaagggagtagacagtctaaagagtgtatcaattggaaagttaggagaatctgaaaatgctctaaaagttgagtcttcatttgatggaacaactgactgggattccaataaacatgaatttacattttatacacataaagatgaagaaataccagctgattctatgatacaatttgacattttgattccaaaagaaaatgaaaaatataatggaacaataaagtattcaggtggaattggggataaggattggagctggaaaggggctggatatggagatataaattctaaagattttgaagatcaagggaatggatatttaaagaaaacagtatcagtaaaaacatcagatagtagtgatggtttaactaaagtaatacttcaactttcaggatatgaatgtacatatgcaggtgacatgtatattgataatataaaattaataaaagcagaaaaagaagaaggggatattcctgctgtagaaccagtttcatggaactttgacaattccaatgaaggatggaattttggaggcgcatattcttataatggtccacaagataatgtagttaattttgatgaagaaaaacgagcattgagattagatgttgattatagcaaaaatgttggggactcttggagtgaatttaaaatagagaagaaatttgagggtgaaaaacttaaacttaatggatataatgtattaacatatgattttatatacgatccaaactgtatgacaaccggtacgtttaaggcaaaattatttattacagatggacctaataaagatgttgctatagatttatcaaatgctgaagatttaggtaatggactaaaaaaggcacaagcggttgttgaatttaataatgcagatattgaagctgattcaataatattaggattagttggaagtaatacagattataagggaagcatttatatagataatattaaattaagtcaggcagcacaagaagatccatatgtagaaaagacagaagaacctgtaaaacaaggattagtatcagtggattctttagagatgccttcagaagttaaattagtagataatgaagcaactcaagcaacagcagacttatatgcttatttaaaggctcttgggaagacagacaaagtcatatatggacatcaaaatgatacacatcacaaggctttatataaacaaggtacgaactcagatacaaaagatgtaacaggttcaatagctggaattataggaatggatacactttcatttacaggggatgaattagaacttacggatgaagaaaagaaagaaggattaacccttcctaagaaagcagctcaaatagatgctcaagcagcaaaagaaggtgcaataattacattatcttctcatatgcctaattttgagattgtaaaaaataaggaattagtagatggaaaatatgattattcagggtattctccaaataaaacaagtggaaatattgtatcaaggataatgccaggtggagatttaaatgaagtttatacaggttatttagatttaatagcagagtatgcagatgaattgcaaaaagaaaatgtaccagtgttattcagaccgtttcatgaaaataatggaagctggttttggtggggaggagcattttgtgatgcacaatcttacaagaatttatttgcatatacagtggactatttaagaaatactaaaaatattcataacttcttatatgtatattctccaaatggaccttttgaaaatgataaagaatatttatcacgttacccaggtgatgaatatatagatattttagcttttgatatgtatcatgatgatccactggcagaggcatcaaaagatccttggatggaaagtttaaaggaaactataaatttagttcaaggaatagcagactcaaaaggaaaattatcagcagtatcagaaactggtataagaattaatggtggtggaatgcctgaaacaggaaatccaaataagacttggtttaaggatgtttcggatataatttcaaaatcagatatgccatattatatggtgtgggcaaactttaataatacagataacttttttgcaccatttatggctaatgataaaaaaggccatgaaatgattaatgaatttattgattattacaatgataaaaatacagtatttgctgacagaatagatgattatgcatcagtagatacacaaattagtgataaatatgcttatggatatataatgactccaatttcaaatgacagaatattagagccagtaactataaaagcagctgttagaaatgcagaaggaaaagttacatttgacatcaagaataaagatggacaagttatcaaaacacttgaagctacagataatgatggtgtattcagtgcaggtattacagaagatgtattaaatgaaattggtcaagtatcaggtacaattgaattaaaatcagataacacagttttaaactatataaatgcagtgtttaatattaaagaagcagaaaagcaaccaaaagttgttgatgattttgaaagctatatgggtgatagcagtctattatctggtgcatggtctacaaataaggggccagggtgtagtgtaaatcctaagttgtcagatgaaaataaacatacaggtgattatggattagcatttaattataaaatttctactgaaaaaactagtgagggatatgcaggaataataaaatcccttgaagcagactggactggctgcgatgcacttcagatttgggctaagccagatggaaaagggcaaaaattagttattcagctaacatcaaatggtgaagattttgagattaggcttcctgaatttacaaaaacaactgaagcacaacttttaaaacttccattcagtgattttacaggaaaaaaaggtgggaaattagatccgagtaatataacaagtatggcaatatattgtaatacaatagtaccagaggacaatgaaggaagttggaatgtagattcaacaatgtattttgatgatatcaaagctattaatacatcagaaagtgaaacggagattggaaatgcatctgtaaatatatctggaatacaaaaagtaggatatacattaactcctattgtgaaagtggaagataaagaaggaaatgaaataactactagtttaaatcttaagtactattggtatcagatggataatgataaagatgaagttaatgatactaattcagttcttataggtactgataagacttataaaatagcaagaagtgattataataaatacattaaattagtagtaaaatatgtagacaataatggtgaagaaaaagaaatatcccatgactatactaaatcaaaaataacgtttaaatcatcaggaagtcattcatcatcaaataattcatcatctgataatgaaagtaatttagataatgatacttcatcatcagaaaatgatttgtcaggagatagtaattctaattcagttattacagaagttattactaatgaagatggaacatcatcaataaaacttgttgatgcaaatggaaaggttatgactggatggcagtttattgataataaatggtatataggcgatgaaaatggtattgctaaaactgattggcagcaggtaaatggaaaatggtactatttagaaaatgatggtaaaatgaagactggttggttaaaagataaagatggagcatggtatcacttacaagcaaatggagcaatgcaaataggatggctaaaggattctgatggcaagtggtattatttgaaagaaaatggtgcaatgagtataggttggttaagggatacaaatggaacatggtactatttgaacaatagtggagcaatgcaaactggttggataaaagatgctgatggaacatggtattatttaaatcagtcaggtgccatgttatctaatacgatagttgatggatatgttcttaataaagatggagcatgggttaaataattataaaggcataaagtaaatactataaggctatatcgaaattgaattgttttgatatagccttataatattttaacataaggttaaaattatagaataaagatatgaattattcatgatatgataattttaaagatatatgtgatgattaatatttgattactacggtggtggaacttgtgaagaatttataataaagattaatggacgattaattgaatttatataaagaatattcataatgacatatattaattgaatatatttatcaattaatatatactaatacatgtttctattttgataaattgaagtatgggatataatattagtaataagatgtaaatgtaattatagatgagaatttctaaagattatagatattatatattctttagaaaaagtgatgtattatcatgaattgaattaataaaacatatgatgaaaaataaatctcattttaaagaaatagtcataattagaactaaaaaatatttataaaatgagattatgatatatatatcaatgactaaggagaaagataatgaaaaaaattataagtaaaaaattaagagtaggaacattactattgtgtactgtaatgatgggaagtatgttttttggctgcagaaaagaagaaaagcaaacaattaactttataaattatggcgaaaacattggtgaagggattttagatgaatttgaagaaaaatatggaattcacgtcaatcaagaagtttatgatgcaccagaagagatgtataataaaataacatcaggagcatcacagtatgatgtaatagtatccatagattatcttgtacaaagaatgattgcagaagatagattagaaaaaattgattttgataatgttacgaatatgtctaaaatatcatctgatcatttaggaaagacatttgatccaaataatgaatatagcgttccatatatgtcaggaactataggaatatgttataatactgattatgtaagtaaaccaatagatagttggactgcattatgggatactgaatatcaaaaaaatgtagtacttttagatggagttcgtgattctcttggggcaacattaaaaatgcttggttattctttaaatactactgatcaaaaagaaataaatgaagcaaaagataaacttatagagcttaagaaaaatggaaacttattagctataggatcagatgataatacagataaaatggcaagtggagaagctgctatatctattctttggtcaggtgaaggactaaatcttgaagcagagcatgataatataaaattcgttgtacctaaagaaggtgctaacttctggattgattcattatgtataccaaagggaactaaaaataaagaaaatgctgaaaagtttataaatttcttatgtgaaaaagatccagcttttagaactgctgatgaaataggatatactacaccacagagtgaagctagggatgagcaagatgaagctgtaaaggataaccctaatgcatatatgccagaagagttgttggaaaaatgtgaaagttacgattacttaggagataagttaaaattatatgaagaagcgtggactgaatttaaagattacagataaatatatagtttagctttgtaaacaatagtttatactgtgaatatttataattgcattttttgagtaataatagttataaagaaatttggtaaaataattaacaaatgaagatttattagtataagttattatataatagtacaaaggagaggattgatgttatgtcagacagaattatagactttaatgaaattaagaataaagttaaggataaggatgtggataagttcgaggaatacatatattctatgtattataagatggctgaaggtaaattaaatatggctgatttttctaaaaatataatgagttatatggaagaaaacaacatttctcaagataaacttatgaatattcaaaaaaagtttttagagagatatggttttgacccttcaatgcttgaagaacagtttaaaatgtctggatttgactttagtggagcaggtttaaattatggagatatgaagaaggccctcagttttcaagaaaagtataagagtagaatgacatcaaaagcaatgtcagagtactttattaataatgaaaaaaataatcttaaagttcttcttgaaggtgaagaagtaatactaataagtgataagaatattgatttaacagataatgaattaaatgaatttttatgttcatataaaaaggttttagaagataaaaaattgaacatagtaatatgtgaaaatataaaaaaatatgagtattaaaatactgcatcagatcaattatcattggtctgatgcagtatttttatataaaatttactcttaggcgtatttataaatatattaaagcggtgaattggaaattacaaagaataatagtccttttgatatattaataatatcatcggatgatatttcagataaatcatgagaactgctattgagagcaattaattttgattttgcttttacctcatcacatttttcagctagtttttcggagctttcaaatggaacaaggctatccgatttactatgaattattaatgtttctggaacatttgaactaacataatttataggattaaattcttgtattacttcatctttattagttattgaagaaaatattttagataaatcaaaattcaagtttgtagtatttaatatgcttaaatcagttggcccagcaaaatctattagatatttaactttgcttggataatcctttaattcttgagaatcaacaaaattatctgaatcactataggctgccattagtgatagatgagcgcctgaagatattcctaaaagtcctatttcgtctgtatcaaaattatattgagatgcatttttataaatccatcttatagtatcttttatatcagaaacttgttttgaaaaattttctttgtttctcataagttcatatgaagtgcttattattgtatatccttgctctctaaaagtatctaaaacaggtgtaagtgcagttggaagagatttatctccatatacccagcttccaccatgaacataaagtattactggtgattttttgtatatattttttaatggtgaatatatatcaagagttaatgaaacaccatttgtgtttttatatgtaatatctttgtaatctatattttcaattggctcgatactaaaagcatcattcatattatcaatttctttttctaatgatatatatttagaagcaattccatataataaataaattcttttatgaaaaattacagtaatacatattattgaagctaataatagtaaaaaaagtcttttaaaaaattttttcataattctatataatgcgcagattactattttaataatatattagtaatcagttaaatcctttctatatttttaatagataatattataacactatattttaagaagatatgaattttaataaaattgtaattttctgagaaaagccattatgaagtttttatacaagataatatttcataagtggttatataaatattatcttagaagtaagaatattaataataatgagtataaaatattgtgcaattaattgtgtgaaaggagaagttaatgagtaatccttttgatatacttgtttatttggatgaaaatctagtcaagaatctatcatccttggtattaacaggatacatagagacaattacactaacgcaggcttttgataaaacactacaggctgggatgaaagaaggagatagactcgagaactccagccagggaagcataagtaaaagtgaaaaagaagggtttagggatgaaaacaagcttgatgcatgtaataattttgaacaccaccatcttgataaggatatcgatgcaaggcaatgtataagagaagagagaaagattcagacaacatatacaacctttgttttgaatggaagtcttatggatcatcttaatcaaaaaaaagagcttcttcataaagatgttactgacatagaaaatgataatatttttacaggagaccttatagaagttgaaggtacaataacaaattcaagtatattatgctatattgattgtttgataaatcttatagatatatttggtgccgattatctaaatactcttcttaagggaaaagaaacaaaaatgaattttacaatgtttcaaaagatgcttactcatctaaatagtcttttgacatgtaataatacccaagacttaataatgaatgttggtaatggaaaagctatcttaactataaataaagataattttatgaacagccagtgtaatgtttttgataagataaattgtcactgtaaagttattggaaaagttataaaaacatgtacacaagaagaggattctataagtctgttaagaaaaactggtcaagaaaacttttatgaaaaattttttgaaaaagcaaagccgctgttagagtgtcttgaagaaaatgatttttttgtacctgaatgtccagacttaagagttaatgaatgtgcaattcagcttatgcctataaacatatacatgtagttttaatagatttatataatataaaaatattacaaaatattaataaaatgaaaaaatataatgtattttatagaaaaacacttgtgtatgaataggatacatgataatatagattataggtagaatatgtttatatatactttaatttgtcgacatttacaataatatataaatccatatctaatacattttttgaggtgagttaaatgaagtttagaagtactagggcttagaaaaggaaatagcttcagccaaagcaataataaatggaatttcaaaagatggtggcttatacgtgccagatgattttccaaaggtttatgatgaactaaagaaaaacacaaagatacaatatgaagatttagcatttaaagtaattaatgagtactttactgatattgacgatgcagaattaatgggggcaattaatgatgcgtataatggaagatttgaagtaaaagtagaaaaaaatttcttagaattatatcatgggccaacttgtgcatttaaggatgcggcgctattatttttgcctcaaataatgaaaagagcaaagaagatttgtaatgttaaagaagatataacaattttaactgcaacttctggagatactgggaaagcagcacttgaggggtttgcaaaagtagatggttttaaagttgttgtttattatccaaagaatggtgtaagtccaattcaggaaagacaaatggtaagtcaagaaggaaacaatgtgaaggtcattggaattaaggggaatttcgatgatgctcaaactggagttaaagaaatatttggggataatgaattcagaagtggattagtggacaagggctatgtattatcatcggctaattcaatcaatataggaagacttgttccacagatagtgtattatttttatggatattttaatttagtaaatcaaggggtaattaaattagatgatccgattaatgttgtcgttccaacagggaactttggaaatattctagcaggatattatgctaaacaaatgggattaccaatagataagtttatatgtgcatcaaatgaaaataaagtgttgactgatttcttcgaaactggagtttatgataagaagagagagttagttttaacagaatctccttcaatggatatacttgtatcatcaaatcttgaaagattgctatatgaagcatgtggaagagactgtgaagttgtagcaaatttaatgaaacagttaaatacaaatggtgtgtatgaagtaaatgataaaataaaggaatttataaaaatcttttatggtaattatgcaacaacagaagaagtgtatgatgcaataagagaagtttatgaaaaagagaattatgttatggatacacatacagcagttgcatatgtagttaaagaaaaatataaaaaagaaactaaagaccataaaccagctttagttgtctcaacagcaagtccatttaaattcccaagaagtatttgtaatgcacttaatgtagatgtagatggaattaatgattttgaagtacttaagaaattatcggaagcgacagaaaatgaaattcctaagaatttagcaaacttagaaaattcagaagtactacataatgaagtttgggataaaagccagatgagagatgcgttattggcttatcttaatgcataggggttttaagcattatgattaaggttagagtaccagctacatcggcaaatatgggaccaggattcgattcattagggttagggctaacattatataatgaatttgaatttaaggaaatagaaagtggtttaaagtttaacggaataccagaagaattttgtaatgaagaaaacattatttataaagcaatgaaatattgttttgataaagcgggctataaatttaaaggattagaaataagtgaaattaagcaagatgtaccaatatcaagaggtctaggaagtagctccacatgtatagttgggggactagttggagctaatgaaatattaggaaaaaaattttctgaagatgaattattggatatggcagtagaaatagaaggccatccagataatgttgcaccagcccttcttggtggcatggttgttgcaatatatgaagaaaataaaaccttctatgataaggtaaatataaaaggtgggctgaagtttattgcagtagtacctaacttcagattatctactgaaaaggcacgaagtgtgttaccaaagtcaattactttgaaagatggggtctataatgtttcaagggcagcacttatggtagcaagtttcacaagtggtaaatatgagttaataaagtatgcatgtaaagatgcctttcatcaaaattacagaagtaagttgattcctggttttgaaaaggtgtataataagagctatgaattgggagcactaggttgttaccttagtggagcagggcctacaatcatggttattatcgacgaaaaggatgagcgctttagcaataagcttaaaaagtttttaaacgaagaaaatttacaatgggatatattggaattatctttagatagtgaaggggcaaccattataaagggtgattactgatgagtggaaattacttggttatagataagagggttttacctgatgtttatgaaaaagttctttttgctaaaaaactattaaaagatggaaaaattaaagaaattacagaggcagtgaagattgctggaataagcagaagcgtatattacaaatataaggaccatgtatttgatttttctgaaacatctgaaggaagaaaagttacttacaatatcattttaaagaatgaaaaaggagtcctatcaattataagtaattacatcgcggagcaaggtggagacatcttaacaataaatcaaggtattcctcttaatggatatgctaatttaagcataactattgatttatcttgtgtggatggagacatcaaaacattgacagatggattaaacaacttaaaaaatattgaaaaagttgaatttatcggaatggaataaaaattagaaaatccgaaatagctatattaattaggctatttcggattttttgttctaaatttattaacataacataatataaatggagaataattattaaattattaaaaaattacataatttggaaggaaagtatatagttttatagaatactatttaagataaaaaagtttgcagtttttgataacgttatcataaattaagtgttaataaaattattttcataaataattttaatatattaattaaaatattttaaataggggagaggttagatggttaaaaaatatttgatgtttgttgatgagaatgggtttatagatggaaaaaataatttttatatggtaggaataatatttgaagaaaaatattgtataggagaaaacagtagtcaatcctcattaaaaagaattatttatgataatgatttagatatctcaatttatgataataacaataattttaaacgaggatgcatattaaaaaaagagatatacaacgtgttaaaggagtctaaatttagcattttagtaagtaaaataaatttaaataataataataatatagacatacttgatgaagcctttaataatctgataaaaaaatattatgactatttattaaataatggtggtaaaaaatctggagttgtagtcgaatcaggtaatgaacttaaaacagttagaaagaaacagaaaattttaaatttatatatggatagagataaaattatagagaagttagataacaaatgtagtgatttgataaacaaatttattattgtaaataatcaagatgaagaatataattgtgcattgagtgttgccaagattataaatgattgtataggttataactatgacagagaaaaaaattatagaaaagaatacagatatagtgacagaatgaatgagaagataatggatataatacatgaaaagatgtttacggaagaaatagcatttgatatgtctaaattggattttatagagatgtataaacatttatttagtttggagaaaaaagtactagaacttgaagatgagttgatggacaaggaaatcaacattaaatataagaataaagaaatacaagaattattagatgaaattaaagtacttcaacatcagcttgatgatgttatattaaatgctaataataatataatatttgagattttatcagatgtagatatacgaataaaaaatattgcagaatagaatataataatgattttatgtataattatatttatgaattatagtattaagaattttaagtataattaataaattttggaggatacaatgagaaaaatattagaaaaggataaacttttaaaaaagtatccttatttagaaaaacaaatgatgaaatataaaattaattttgagaatttgcaggagatatatagcgattatataaattataaaaattcatatgaaaatcaagctagttttatagcaaatattttgagatctcaaagtatggttcattcagtaaagtcaagaattaaggatccagaaagacttattgaaaaaataataagaaagactgaagaccgaaaaaataaatatggtgatgaatttcagttttctgtagataattataagaatgaaattaatgatttaataggaataagagtgattcacatttttaaagagcaatggagagaaattcatgaatttataataagcacctggaaagttatagaaataactgctaatataagagaaggtgataatactaaagattttgaagaattggatatagaagtaagatccagagcttcaggatatagatcagttcattatcttgtagaattttatcctacaaatcaaaaagtgattgcagaaatacaggttagaacaatatttgaagaaggatatggagaaatagatcataggcttagatattctcatgatgaaataccagaaatacttcaatctaatttgttattatttaacagaattgttggaagtgcggatgaaatggcttcgcttattaataatttaaataaagaatggattgaaaaagaaaataagtataaagaagaaattgaaatgttaagaagaaaagtcgatgaaatggaaagaacattataataaaaattaaattgatataataaatttaccaatactatgtaaaaacaataaaattatgcattatttcaatatttttttgaaaaaatactttaaaaatgtagaataaagagttataatatttacaaaatagtctataaagtgctatttatcataatttacataagaagaaataattagtttaaatcacgtttgatttaattaaggttaataatattcatattattaaccttaattattgatataaaaagaatactggaggtgagaaattgtgatatttgtaccatattataaattacaagaaggaatgaaggttgctaatgatatatctttaaaagatacggaaaaatcaaaggcttttttattaaaagaaggtgctatcttaacaaaggataatatattaaaattatcaaattttaatatatctggagtttatattgatgatggtagaacaaatccgatacttgatgaaaagttaagaaaagaatcagttcgtgcagtaaaggaaatttttaatttatgtgaaaatactcataccatacttaatgaaaatacattaaaacagattgaaagtatttcagaaaagttggttgataatatttatagtgataaacaaatttcagtaagcatatcggatttacagacgtatgatttaaatacatatttacattcagtcagcgtaacagttatttcaatagctattggtacggcattaagtttgacaaaaatggagctttgcaagttaggggtatgtgcacttcttcatgacattggaaaaatagagatacctattgaaataattaacaagccttcaaagcttaccaaggaagaatttgaaattgtaaaaacacatgctcagttgggtggaaattttgttatggatcataagtgtgtaagtgatgatatatatatgggaataataagtcatcatgaaaaatacaatggaacaggatatccacatgcattaaaaaaagaagagatacctttatttggcaggatcattgctgttgctgatgtatatgatgcattaactggaaataggccgtatagaaatcctataaaaccattagaagctatagaatatattatggctggagtaggaagtagttttgattataacattgtaaaggcgtttttgaggaaaatagagccatatccagtaggttcttatgtaaaacttagtgataagagatgtgcaagagttattggggttaataaggatagtccattaagaccgataataaaaattgcagatagaagtagtaaaataatagatctgaaaaatgatgcggattcaagaaatatagtaataattgatattgattatagttatttaattgttgataatcaagaaaaatgtgtataaagtgggggagtaataatgaaaaaaataggatttattggcgttggtgttatgggaaaatcaatggtgaaaaatttaataaaagcaggacatgaagtttttgtatatacaagaactaaatctaaaatcatggatgtaattgaagatggtgcaatatggtgtgatgatataaagtcatgtgctaaagataaagatgttattattacaattgtaggatatcctaaagatgtagaagaagtatactttggtgaaagtggaatattagctaatgctaaagaaggaagcatagttattgatatgacaactacaagtcctaaattatcaattagaatatatgaggaagctaagtctagagatattaaagctttagatgcacctgtatctggtggtgatattggagctaaaaatggaactttatcaattatggtaggtggagataaaaatgcatttgaagaatgtaaggacgtgttagaatgcatgggaactaatatcatatatgaaggaagggcagggaatgggcaacatacaaaaatggcgaatcaaattgctattgcgggtgcagtgtctggagtatgtgaagctataacatatgctaaaaaagcaggacttgatgtgaatacaatgttaaacagtattagtgaaggtgctgcaggaagttggcagatgagcaatatgggacctaaaatgattaatgaagattttgcaccaggattttatataaaacactttataaaagatatgaaaattgcagtagaagaatgtgtggagtttaattcagaacttaaagttcttaataaagtattagaaatgtatgaaactcttgaagtaaatgactgtggagattttggaacacaagctcttataaaatattatgaataaatttagagtgttaaaaaataattttttgattattatttaaaagaaaaggctatacatagagcctttttttgttataataaaaaaagaaaacatactaaacttataagaaaactgtatattataaattgtaatataaaaaattttaagtgaaaaaatatatttataatatttattgaaacgaagcaaatatattttataaattatgcaaaatatagaatatatgataggagagaattttaatggaagtatattttgataatagttcaacaacaaaaacttatgatgatgtaattaatgaagtttgctatgggcttaaagaattttatggaaatccatcatcccttcataatcttggactaaagagtgaaaaaaaattgaaagaatgtagagatattttagcaagaactattaattgttctgaaaacgaaatttatttcaatggtggaggaagtgaaggtaacaatctgattttaaagggtgtgttaaaaagcggaaatcatcttattacaactccttttgagcatgcttctatattaaataccataaagaatttagaaaaaaatggtgtgaaagtaacagtattaaagattgatgataaaggaaaagtagacttagaagatttgaaaaattctataacaaaagatactgtattggtgtcaataatgcatgttaataatgaaattggtattattcagaatatagaagagataagcagaattgtaaagaaggctagttcaagagcaaagattcatattgatgcagtacagagttatgggaaattaccaatagatgttgaaaagatgcagattgattttttaacggtaagtgctcataaatttcatggaccaaagggatgtggttttacatatataaaaaaacaagctgtaatatctccattaattgaaggtggttctcaggaatcaggtataagggcaggaactcaaaatatatctggaataatggggatgacagtagcagcgaaaattgtgtgtgaaaatatgaaggataattatgaaaaagttttatcaataaaaagaagatttattgataaactaaaaaaaatagataatataagaataaatagttatgatgaggacagtttttcgccttatatcttaaatgtttcatttagaggtgtaaggggtgaagttttacttcactttttagaggaaaataaagtttatgtatctactgggtcagcatgctcttcaaaagaaagggctaggattggtggaagttatgtactgaaagcgctagggcttactaatgatgaaattggaggtggaatcagattttcatttagcgatgataatgaattagaagaagttgattacactgtagaaactttagaaaagggacttaggttcttaaggaggataaaaagataatgaaagatcttattttagtaaaatatgcaccagaaatatttttaaaaggacttaatagagggaaatttgaaaagaagctcagagataatattggaaaaaagcttgaaggaataaaagttgaatttatacatgatagtggaagatactttattaaaactgaccagattgaagaaagtatcaaaaaaataagcaaagtatttggaatattggaagtttgtaaagttaaagaagtagcgattgatattaatcaaatacaagaagtagcactaactaaaattaaagaatgtgaaggaaaaacatttaaaatagttacgaacagagctaataaaaaatttgaactgaattctatggaagtatcaagatgtgttggtggtcatattcttaccaatatgaatgatgaacttacagtagatgttaaaaaaccagaaattcaaataaatatagaaatacgtaataattttgcatatgtatggtcaaataatgatattactaaaggtgttgcaggacttccatatggtatgaatggaagtacaatgcttatgttatcaggtggaatagattctccagttgcaggatatcttatggctaaaagaggtgtggaattaaattgtgtttattatcacagtcatccttatacctctgaaagagcaaaagacaaggtaaaagaacttgcaaggatactatcacaatatacagaaaaaataaatttatatatagtaccctttactgatatacaaatggaaataatagataaatgtagggaagatgaactaacaataataatgagaagatttatgatgagagtagcatgtaaacttgcggagaaatataatatagattcagtatgtacaggtgagagtataggccaggtagctagtcagactatggatggcttaatagttagtgatgattgtgcggatagacctgcttttagaccacttattgctacagataaaacagatataatggaaatagcgagaaaaataggcacatatgaaacttcgattcttccttatgaagattgttgtacaatttttgtaccaaagcatccaaaaacaaatcctaagcttgagcccataaggaaacaagaagaaagcttaaatgtagaagaattaattgaaaatgctataaacaatatggaaatagttacattttaaaatagaaatctcaaagctgtgtgaagagtcacattagctttgagattttttgaatttatattcatttatggtgaatagaaatatagatactattaacatgaatacacaaaaccatattgatttataatcgaaatatgatgttaaaatggctccaagaagagcacctattataaatgtaattataatggtaccataacgtaaagatttcgtaagctcatctgaattattacttgaaataccagtataaaaagcttcgcatgctgatcttaaatttcctgtacacattgcagtgctatatggagttccggatagttttctaaaagatgctatctgaagagaagaaacaaaagatatagcaactgtaactattaaatttggtgctgtagttggaatcagtcctactaccaataaaactattacttctaatattaaaattgctcttttagaatgaattcctggaaaaacaaaatgatgtttttttctccattcacatatgagaacacctgctacaaatgctaaaattggcaataaagcagttaaggtttcaagaatatttcttttggtaacagcaatggcaacaagaacaaggttaccggtctgggcattggcgaaaacgccacctctacataaaaatgtatatgaatctaggaagcctcctacaattgataacaaaattccaagagtaactgattcggatgtttggttgtgtatatcaaatttgtttatatgtttttcagaattttcatatgcaattataaaaatcccctccttatcttgtaagtttcaattataagccacagaggcaagataatttctcgttaagtaaattacaatttgtctactgagaattacaacagatatattataacattttattaaagagaaggaataaaataattgggaaattttgaatggtttattgacaaaaacatggaaagagagtaatattaacttaaacagtttagcacgttaaattgataaaatgataaaatgattaagcagtaaaataagtgggggttaaatatgaagaaaaaaaacattcttccagaaggaacaagggatttaatattagatgaatgtattgtgaaaagagcaatagaaagagatatagatgatattttttataaatggggatataaagaaatcataactccaacagtagaattttatgaaacttttaatcatgattctcaaacattaaaagaagaagatatgtataagttctttgataataggggtagaattttggtacttagaccagatatgacaatcccaatagcaagggttgttgaaacaaaatttaaagatgaatctctgccaattaagcttaggtacaactcaaatgtatttagagttcatgcaagtcttggaggaaaaagaaatgaatatacagattgtggagtagaacttataggacttgaggataaaaagtcagatttagaagtacttgttcttgcattagaagcattagaaaaacttggattaagtgactttaaacttgaaataggcaatataggtttttttgaaggtgtatttaaaactcttaatataagtaaagaaagtaaagaaataattgctcaatatatagaagataaaaatttgaaaaatcttgaagactatttagatgaaattgatattaaagatgaatataaagagttttttaataaacttccatggctttttggagatagatcaatcttggaggaagcaaaagtattagctttcaatgaagaattaaaggctaatttagagtatcttgaaaatttatattcagagcttgatattctagggtatggtaataaagtaacatttgacttaggaatggttccaagattaaattattatactggaataatatttaggggatacggagaaggtgttggaaatacagtacttagaggtggaagatatgataatcttattacaattggagaagaatatattccagcaataggattttctttagatattaattctgttattgagaatgttaaaacaagtgaaaaaataaatactattgataaaagctgtaaaatttattattcatcaaaatatagaattgaagctataagaaaaagtgaacaacttagacaagaaggaaaaatagtagaattgatacctgatgacagtgtagatgaaattaaggtattactataagttagaatattaagttagtaatttgataaattgggggaaatagaatgagcataagtattgcattgacaaagggcagattagaagaagaagcggtaaaacttctagaaaaatcaggatatgatccatcagaattgaaaaataagggaagaaagcttgtatttaaggataagaaccaagaaattaaatattttttggtaaaggcagcagattccataacttatgtagaacatggtgttgcagatattggagtagtggggaaggataccatattagaaagcgaacataaatgttatgaagttctcgatttgggatttggaaaatgtggatttatagtggcttcattaccagaaaataatatattcaaaaaagttggacatataaaaataggtagtaagtatcccaaagtagctaaggaatattttaagaagaaaaacatggatgttgaagtaattaaaattgaaggatcagttgaattagcaccaatacttggcttatgtgatggaattgtagatataatggaaaccggaacaacattaaaggaaaatggacttgttgttcttgatagaatatgtgatataagtgcaagacttatagttaataaagcaagttttaaaatgaaacaaaaggaaattggagaatttattgagggcattaaaggaaatattaataattgacaaaaaacgcagaatgttgataataataagtaagatattttaattaattgataataaaaaataaaattatttgacaaattatctatttgatcatgtggggctgaatatgaaatagattatttgataactacaaattttcaactatacacgatcaactgaaaataaggggctattattaaatgttgaagttaatggagattagtgaaagcaataaacagaaattaattaatgaacttaaagagagatgtgaagaaacagaacaggatatacttcttaatgtaaagaatattttagaaaaagtaaaaaaatctggggacaaggctttatttgattttaccaaggagtttgataaagtagagttgaaagatttagaagtatcgaaagatgaaatagaagcatgttttgataaggttgaggaaaattttatagaagcattaaaagaagctaagagtaatattgaagcatatcatgaaaaacagaaatcaaatggttttctaatgactgaagatagtggtgtttatttggggcaaagagtactgcctcttgaaagagtaggtgtttatgttcccgggggaacagcagcatatccttcatcagttttaatgaatgtaattccagctaaagttgcaggggttgatgaaattgttatggttactcctccagacaaaaatggtggtataaatccatatataggagtagcagctaaaatagctggaattgataagatttataaagttggtggagcacaggcagttggtgcacttgcatatggaacagaaactattaaaaaggtagataaaatagttggaccaggaaatatatttgtagcaactgccaaaaaattagtatttggacaagtagatatagatatgatagcaggaccaagtgaaattcttgttatagcagatgaaaagtcagatccatcttatgtggctgctgatttaatgtctcaggcagaacatgataagcttgcatcggcaatacttgtaacaacttcaaaggatttatatgaaaaagttgagttagaattagataagcaagcaaaaacattagaaagagaagaaataataagaacatcattaaatgattttggaaaagcaataatatgtagcaatattgaagaatgtatagatatatctaattccattgcaccagagcatttggagattatggttgatgaaccaatgcagtatttaggactcgttagaaatgcaggttcagtctttttaggaagatattgtccagaacctataggagattattttggaggaactaatcatgtacttcctacaagtggtacagctagatttttctcagcattatcagtagacagttttataaaaaaatcatcattcatctattattcaaaagaagcaattatgaaaaacggggaaaagattattactatggctgataaagaaggattaacagctcatgcaaattctattaaagtgagattgaaagatgggcgtttataatcgatacattgattccgctgaggaattcaaaattaaattagatgctaatgaaatctttatgaatgtagatgataatgtgattatgaagataaaatctagtttgacaggtattgacctatatagatatccatccaatgaaatgggagatataaagaaattatatggtaaatatgcaaaagttaattcggaaaatataattgtgggtaatggatctgatgaagtacttgaattaattataggaaaagttattggtacacaagggaaggttttatcttttggacctgactttgtaatgtatgatttttttgtgaagagatttaaagggaacttataaaatatgatataggaacagaaatgaaatttgatgttgatagatttattgagttaggaaaatcaaataatgttgatatgatcatattttcaaatcctaataatcctacaggaataaatatttctccaaaagatattgtaaagatactagaagaatttgaaaattctacagttgttattgatgaagcttattatgaatttaatggagaatctatgattccatatataaataattatagcaatctttttattacaaggaccctatcaaaggcttgggggttagctgcccttagggttggatttttgataagtagtaaagaaaatattgaagaattgttgaattataaagtaccttatacaataagttcgtattctcaaaagattgcagaaatagctttgaaatatcctgaaaaaataattaataatacaaaaataataataagagaacgtgaactgttatatgaaagattaaaagagattgaaaaaaatgcagctatgaaaatagaattttttaaatcaaagggaaattttatatttggaagaacaaagcataaagaagcattaataaagggacttgaaacccacagaatatatataagaagttttaatgatgatagttttagaataacagttggttcacctagagaaaatagaaaagttatagaagctataaaagaaatttttgtatattaattgatgaaaggatttatataaaatgagcgatagacttgcaactttaaaaagaaaaactaatgaaaccaatattgagcttgaaattaatctagatggtcaaggagctagtgaaataagaactggagttggattttttgatcatatgatgactttgtttgcttttcatagcaaaatcgatttaaagatcttggcaaaaggtgatcttgatgtatgtgatcaccatacaattgaagatataggaataacattaggggaagcctttaagaaagctattggtgacaaaagagggattaatagatatggaactttttatgttcctatggatgaaacactagctatggtttctcttgatataagcaatagaccatttgttgtttttgaatgtgatttcaaaagagaaatggtgggagaaatggctactgaaatggtagttgaattttttagggcatttgcttttaatgcaggaataacactgcatttaaaagtattatatggtgaaaatgatcaccataaaattgaagcactttttaaagcttttggacgagcgctaaaagatgcaaaaaaaattagtgatgaaaatggtattccttcaacaaaaggaacgatttaaagttgattgatatttgggggcgttttaatgattgttataatagattatgggatggggaatttaaaaagtgtcagaaatgctttgaattatctcggaatagaaaataaaatttctgatgattatgatgaaataagaaaagctgatgcattgatactcccaggagttggagcttttccagatgctatggataccattgaaaagcttgggcttgataaggtgataaaagaagagactgaaaagggaaaatatcttctagggatttgtcttggaatgcagcttttatttgaaaaaggatatgaagggctagaaagaacaggccttggtcttataaaaggtaatattgttaagatgaaagatgatagagaaaaaaacgtaaagatacctcatataggatggaataatttaaaatataatagaaaagatattctttttagaaatatagatgaaggtaaatatgtttactatgttcactcatattttgcacaatcgtataatgatgaagatttagttgcttatagtgaatatggtgagaataaaatacctggaattgtaagaagaaataatattataggggctcaattccatcctgaaaagagtggaacagttggattagatatattaaaaaattttggggagttgattaaatgataattttaccagctattgatataattgatggaaagccagtaaggctttatcaaggtgattatgataaaaaggagatagttgcagaagacatatttgaaactgcaaaatcatttgagaaaatgggagcagaatatattcatttagttgatcttgatggtgcaaaaagtgggagcaatgataatcatgaattggttataaaaatagctaatatgttagatattcctgtagagttaggtggaggaataagatcatttgaaactataaagtaccttttagaaaatggagtttcacgggttatactaggtactatagccatggaagatgaaaatctattaaaaagggcaatttctgaatacggtgaaaaaatagcagttggtatcgattgtaaagatggtaaagtttatggaagaggatggctagagggaagcaatcttgattatattgaatttgcacaaaaaatggagtcattgggtgtgaaaaatataatagtaacagatatttcaaaagatgggactcttcaaggtcctaatttagatatgctaaaaaagattaaagaaacagtaaatatagatataactgcatcaggtggaataagagatatagaaaatataaaagatttaaatgaaataggactttatggggcaataacaggaaaagcaatttatgcagaaacattatcattagaagaagctataaaagcagtaagaaattaataaaagccagagatataagcattatgcttatgaaagggggaagcattttatgcatacaaagagaattattccgtgccttgatgttaaagaaggaagagttgttaaaggaattaactttgaaggtcttgtagatgtaggagatccggtagcacttgcagagtattataataaacagggtgcagatgaattggtatttttagatataacagcaactcatgaaaaaagagggataatggaaaaagtagttgagagtgtagctgaaaaaatatttataccatttacggttggaggaggactaaaaagtattgatgatataaaagctattttgagagcaggagcagataaggttagtttgaattcggcagcagtaagagataaaaacttaataaaagaaggtgcattttattttggaaatcagtgtatagtattagcagcagatgctaaaaaaagacctgacaagactggatggaatgtagttattaatggtggaagaatagatactggaatagatttattaaagtggattgaagaagcgacattattaggtgctggagaaatattgttaacatccatggatgctgatggaactaaaagaggttttgatttagaacttacaagggcagtaagtaacgtaactaatgtgcctgttatagcatccggaggttgtggatgtttggaagatttttatgatgtatttaaagataatactgcagatgcagctttagcagcatcactttttcattatggagagttgacggtggatgaagttaagcaatatttaaatgacaaagaaattgctgtaagattataagaattgaattagcaaaaagggggtacatatggatatttgtagaagagctcaacaaattgattttaaaaagggaaatggattagtacctacaattgttcaagactttaaaacaaaagaagtacttatgcttgcatatatgaatgaagaaagtttgaggaaaacactagagggtgatacaacatggttctacagtagaagcaggaatgaattatggaataaaggagctacttcaggacattttcaatatgttaaggaaataaaggtagactgtgataatgatactattttagtattggtagagcaaaagggtgcagcttgtcatacgggaaacagaacatgcttttatagggatttgtaaaattggaataaaatataatagggggcaaaattagtgaaagaaaatataaatgatttatataatgttatattagaaagaaaaaacaatgtatctgaaggttcctatacatcgtatttatttgaaaaaggtgtagataaaattttgaaaaaagttggagaggaatgtacagaagtaataataagctgtaaagaagatgataagaaggaacaaattaatgaaatatgtgacttagcttatcatgtacttgttttaatggcacaaatgggaatatcagtagatgaaatttcagaagaacttggaaatagaagagaaaaaataaataattttaaaggtgaaagaaagccgataacaaatgtttaattaataattcatgaatttataaatggaatgagcagattttagctcattccattttctttttatatggaagatttcttatgtacatcaataaatcttaagggtataatataggaaaagctcaaaaataattgaattaatattaattatggaattgatacattctatataaagctcaggaaagaaaggatgaatatacaatgaagaaaatacctttttcaccaccagatataacagaagaagaaatacaggctgtatgtgaagttttaagaagcggatggataacatcaggaccacagcttgcaaagtttgaagaaggaatagaggaatactgtaacgtagagaaagcacttgcattaaatagtgccacagctgcaatggaattagtattaaaattttttgatataaaagaaggagatgaaataataacaactccttacacatatacagcaacatcaagtgttgccgttcatagaggaataaaacctatatatgtagatgtaaaaaaagatacatttgaaatggacatagataaagtggcagaaaagataacagaaaaaacaagagttataatgccagttgatatagcaggagttccttttgactatgatggacttaaaaaagtattgaaggatcttggaagagaagatattatgatactttgtgattcagcacattcatttggtgcaaaatacaaaggaaagccagttggttcacaatgtgatttccattcgttttcatttcatgcagttaaaaatttaacgacagcagaaggtggagcgcttacttttaaggataataattataaaggaaatgaagatcttttaaagtatttaagatttacagcaatgcatggtcagtcaaaagatgcattaagcaaaatgaaagctggagcatgggaatacgatataataaatgatggtcttaaatgcaatatgacagatataagtgccgccattggaaatgttcagcttaagagatataataagatgttagagagaagaagagatatttttaaagtttatagtgatatattaggaaaagaagatttttcaataataccatttactaaagatgacaatggaacagaaacttcatatcatttatatctttatagagtaaaaggatttaatgaagaaaagagaaataaagcaattcagattttagcagaaaaaggaatagcaacaaatgtacattataagccacttccaatgcttacattgtataaaaatttaggttatgatattaaagattatccaaatgcatatgctatgtatgaaaatgaaataacacttccagtctacagcacattagctttagaagatgctgaatatatagcacgtgaagttgtaaatgtaataaaggaattaatgtagaagttataactttatattttattgtaaaaaaatctttttgctgtgataatcattgcaaaaagatttttggttttaataattaaaaaaagaaaatccaatattttattggattttctaatgttcatttaagaaagggaataaatgaacattgtgggtttattaaactttatggtgatgccataaagtgtatgggctaaataacttctatttataactttattatacaataaacaaattaaaaaacaataattttttacattgcgacaattaaatgtataaaaacttaaaaaatttctgaagttatatagagaatgtattaaaatacaatgaagtattattataaaattaaatgatttataaagtaaacttgtacaaaatttatcaaatgatataaggaggtaatagatgatagaattaaaaaaggaagagttacttaaaaatactatagattatgaagagtattgtgaaaatgtgtgtagtccgactttggatgaacttagggatgcaggaatgcttaagtgtggaggctgcagtggtggatgtgcttgcaagagcaaaggtaattgttctggatgtaaaagtaaaaaatgtgaaaagtaatatttaaaatatgtggatttaataataataataatatataattaagtttgtttactaaatcaatgaaattataattagatgtggaggggttatccttgggaaagccaagtatcttcagcagagaatatgaacgaaaaatgaaaaaaagaagaagaaatatcataattttttcgttaataatagtcgtattagcatgtgctactatacttaaatttgtatacaatcctgttaatttcagcaaaataaaagctaatatacaagcatggattgatagtgatactacatcaacggggatacagctaaaaacaatgagatcaaagaagctgatgagaaaaaagctgatgagaaagaagaagtagttgaagaaaagaaaccagttgaggagtatgtagatatacttcaaagtagtggaaacactgcgaaagctgtctatatagaagaaaatggggaaaaggtatttacagaagtaagaaatttagataatggagtaagtttcgacataagtccatcgaaaaagcaacttataatatgtgatgttaatactcagattacactatataatatagatggtacaaataaaattgtatcaaaagataaatatgtatctacaaatggaagtgtatttactaaagataatacacttcaatcaaaacctgattatttatggaatagtaatcctaaatttgttagtgatcaaagtatagtatttgtaacaaatagaccatactttggaacagcggctgtaaagcaatatctatggatgactgatttacaaactggaacagacaagatatattgggatttagcagcagctaagatagttatgggttctagagaagataaaggattaaaaataactgtagataatagagagtattttatagcgcaagatggtagttatgttcaataaaaataaatatttgatataatttagaggtttatggtataataacctagttaaattagatgtatactattttaggaggaaagaataaaatgaaagctaaagtggaaaaaatagaaacaaacgttgttaagttagaaataagggttgaagcagataaatttgatgctgcaattactaaagcatataacaaaaacaaaggaagatacaatataccaggattcagaaaaggtaaagttccaatgaacatggttaaaaagttctatggagtagaagtattctatgatgatgctgttaactttgctatagatgaatcatacggtgaagctttaaatgctgaaaacataagacctgttgattatccacaagttgatgttgttgaattaggtgaaggaaaagacttagtttatactgctactgttacagtatatcctgaagttgaattaggagattacaaaggtttagatataaagaagcctgtatatgaagttgatgaagctgaaatagaaaagcaaatcaaagatatgcaagaaaagaacgctagaatggaagttaaaactgaaggaactgtagaaaaaggagatatcgctgttatcgactttaaaggatacataggtgaaactgcttttgaaggtggagaaggtcatgattatccattagaaatcggatcaggtactttcatagataactttgaagatcaattaataggattagcagttggagataagaaagatattaatgttactttcccagaaagctatggtaaagaagagttaaatggaaaagctgctaaattcgaagtagaaattaaagaaatcaaagttaaagaattaccagaattagatgatgaatttgcaaaagaagttgcagcagttgattcatttgcagaattaaaagaaaacttaaagaaaactttagaaaagaacaatgatgaaaaagctgaaagagaattcgaagaagcagtaataactgcagtaattgaaaatgcaaagatggatgttccagaagtaatggtaaacaaagaaatcgatgctatgatgaaagatcttgaaggaagattaaaatatcaaggtttaagcttagatcaatacatgcaattcactggtaacacaactgaaaagatgagagacttcatgaaagaaaatgctgaaagaaaagttaaagctgatttagttcttgaagctgttgctaaagcagaagaagttaaagctactgatgaagaaataaacgaaagagctttagaattaggaaaaatctatggaccaaaagatccagaaaagatggctaaaatattagctaaaactcaaaagcctatgatcgaaaaagatatcgtaattgaaaatactcttaaatttataaaagaaaattgcaaataattttatttgagttataatattaaataagttattgaatagtaattgccagaaaaattaatttttctggcaattatttcaaataacaattaacaaaattataaaaagaatatataattatataagtagatttatattataacggtgaaaagggaggattcaaatgagtttagtaccaatggtcgttgaacaaacaagtagaggagaacgttcttacgacatattttcaagattattaaaagaaagaataattatgttaagcggagaagttaacgatgccagtgctcagttaatcgtagctcaactgttatttttagatagtgaagatccagataaagatatttctctatatataaacagcccaggtggttctgtaactgctggtatggcaatttatgatacaatgcaattgataaatgcagatgtatcaacaatttgtgttggaatggctgcttcaatgggagcgtttttactttcttgtggtgcaaaaggaaaaagatatgctcttccaaatgctgaaataatgatacatcagccacttggtggattccaaggtcaggtaactgatattgaaatacacgctaatagaatgttaaaagttaaagaagttcttaataagactttaagcgaaaatacaggaaaacctttagaagttattcaaagagatactgaaagagataactttatgagtgctgaagacgctaaagaatatggtttagttgacgagataattgttaaaaaaccaaagaacaaagaaaaatctgaatagaaataaaaagttatttagatactttttaagcgaggtgaatgtatggctaaatatgatgataaaaaacagttaaagtgttcattctgcggaaaaactcaagaacaagttaagagacttattgcaggtcctggagtttatatatgtgatgaatgtattgatttatgttctgaaataattgcagacgaattccaagaaactgttgattttgatccaaagagtgttccaaagccaaatgaaataaaagaatatttagattcttatgtagtaggtcaggatagagctaaaaagtctttagctgttgcagtatataatcactacaagagaataaacactaataaagatgatatagatgttgaattatctaaaagtaatatattattacttggaccaactggttcaggtaaaacattattagctcaaacattagctaaattcttaaatgttccatttgctatagcagatgctacaacattaactgaagctggttacgttggtgaagatgttgaaaatatattattaaagttaattcaaaatgcagattatgatgtagaaaaagctgaaagaggtataatctacattgatgaaattgataagattgcaagaaagtctgaaaatccatcaattactagagatgtatctggtgaaggtgtgcaacaggcgttattaaaaatcttagaaggaactgtagcatctgtaccaccacaaggtggaagaaagcatccacatcaagaatttatccaaataaatacatcaaatatattatttatttgtggtggagcttttgatggtgtagataagataattgaaggaagaacaagaaaaagttctatgggatttggagctgatatccaatctaaacatgaaaaagatgtaggtcaattatttaaagaaataatgccagctgatttattaaagtttggtttgattccagaatttgtaggaagacttcctatacttgttacattagaatcattaaataaagaagctttaatagaaattttaacaaaacctaagaatgcccttgttaagcaatacaagaagctatttgaattagatgatgttaaattagactttgaagatggtgccttaactgcaattgcagctgaagctataagcagacagacaggtgctagaggtcttagagctattatagaagatataatgaatgaaataatgtatgaaataccttgtgataatagaataactaaggtaataattacagaagaaacaattaaaaataaaaaggatcctatagttgaacgtcttgaagatggaaaaacaagacctgctttaataaaagcaagaactaaaaaggatatagaatcagcataaatttttagtttaaccctgttctgatatttaatatcagaacagggcttttatttatgcattttttcacaatactttaattttatatggaagttaggaatatatttgtaaagtagagcaaataatagtaatagaactagtggaaggaggaagatatatttcattatacgaaagaaatatattcagttatatgaacagtatattaatgattttacaaatagttgtattagttatgatggtatatgtattgtcaacttctgtaaataaaaacccgaaaagcaggagtatagttattgataaagaaaataccaaggaaatgtctcatcttaataaattgagacaaatatccttgtcagttccgttaacagagaaaagcagaccgtcaacattcgaagaggttgtagggcaggaaaaagggataaaagctcttaaggctgcattatgcggacctaatccacaacatgtaataatttatggaccaccaggagttggaaagactgctgcagcaagattagttttagaggaagctaaaagagctatgtcatcacctttcaaagaaaatgctaagtttgtagaactagatgcaactacattacgatttgatgagaggggatcgccgatcccttaataggttcggttcatgatccaatttatcaaggtgcaggtaattttggaatagctggaataccacaacctaagcctggagctgttactaaagcacatggtggaattttgtttttagatgaaataggtgagcttcatcctatagaattaaacaaattattaaaagttttagaagatagaaaggtattttttgatagttcttattatagttctgaagatcctaatatgcctaaatatgttaaagaggtgtttgagaatggccttccagcagattttagattaataggtgcaactacaagatcacctagtgaaataatgccagcaataagatcaagatgtgtagaaatattttttagagcacttttaccagatgagataaaaacaattgctaaaaattctgttgaaaaagtaggacttcaaatagaagaaaatgctttagatgaagtaagtaattattgtacaaatggaagagaagttattaatttaatacagcttgcatctggtatagcaataaatgaagaaagatatgcaataagtattgatgatattaagtgggttctagaaaatggtcagtatacaaagataataagcaatattataccacatgaatcaaagataggagtagtaaatggattagcagtttatggtgctaatataggtatgcttatgcctttagaggtaagttgtaaaaaagtatataacagaagaggtgaagttaaagtaactggaatagtggaagaagaggaaattacaactaataataagaaaataaaaatgaaaagtactgcatatgcttcagtagaaaatgtacttacggtacttgataatctctttgatctaaatacagataaatatgatattcatgtaaatataccaggaggaatgcctgttgatggtccatctgctggtataagtatagcaacagctatttatagtgcaataacaaaaaagaaagtaagtagatttgttgcaatgactggagaaataagtattttaggtcttgttaagccaataggaggagttaaagcaaaaatttcagcagcagttaagtcaggtgctaagaaggttataataccacaagaaaattatgataaatcattagaagaaattgaaggaattgaaatattacctgtaactaattttaaagaagtaataaatgtagcattagaaaatgaagatgttgtagtgaataatacagagatattatcagcaaaaggaaataatgttattgaaacatagtaaagccctcaacttctaaaaaattaatttgtaaaaatataataattagtttaatataatataaagggcgtgaatagttaagataaggttcttaaaattcacaccttttctatttaatagtttttaaaggataattgaaaaaatattagattatgtgtatactagttaagtcaaaataaataatacaatataattcatgtggggggaaatagtattatgaaaaagttatatacaattccgctaattccattaagaggattgactgtttttcctaaagtagtagtacattttgatgttggtagaaagaagtctactgcagctattgaacaagctatgttagataaccaagagatttttcttgtgggacaaaaggatttattagttgaagagccaacgagagaggaagtatactctattggtgtaatatgcaaaataaaacaaattcttaaaatgtctgaaaatactattagagttcttgttgaaggtttagaaagagcaaaaatagttgaatatatagaagatgatgaatatataaaagcttcagttgaaaagatacgttcaaaaaaatctaaaagtgctgagttagaagcgtatattaagcttatagacagagaatttatgaagttattaaaattaactgatgatggttatagtgaagttgcaaaatcaatagagccattagaaagtccaattgaatatttagatatggtagcttcatatgcaattacagaagaagaggcaaagcaggaagttttagaatgccttgatataatagcacgagctgaacttattttggaaaaaataaaaagagaagtttcagtagcaaaaatacaaaaagatattgcatcaaaggtaaaaagtaaggtttcaaaagaacaaaaagaatattacctaagagaacagttgaaagctattcaagaagaacttggtgaagatgatgaagaaaaaaatgaaattgccaagtatgaagaaaaaattgaaaaattaaaaattgcaaaagaaataaaggaaaagctcagctatgaacttggaagattaaagaatatgagttcatcatcagcagaagctaatgttataaaaacatatttagactgggctttagatattccttggggaaaatattcaaaagaaagtatagatatagtaaaagctagagatattttaaataaagaacattatggcttggatgatgttaaagatagaataatagaatatttagcagtaaaacaggttagtaaatcacaaaaaggacctattttatgtttagtaggacctccaggagttggtaagacatctatagcaagatctatagctaatgctatgaatagaaagtatacaagaatttcattaggcggtatgaaagatgaatcagaaataagaggtcatagaagaacttatgtaggagcaattccaggtagaattacttatgctttaaaagatgctaaaactatgaatcctcttatactatttgatgaaattgataaaataagttctacttataaaggtgatccatcagatgccttattagaaatattggataatgagcaaaataaggattttagagatagctatttagagcttccattaaatttatctaaagtaatgtttatcgctactgccaatacactagaaactataccaagaccattgttagatagaatggaagttatagaagtttcaggttatacttatgaagaaaaatttaatattgctaaagaacatttaatacctaagatttttaatgatttagacatacctatggataacattaaaatagaagatgagtctataagagtggtagttgaaggttacacaagggaatcaggtgtgcgtggacttgagagaaaacttacatcacttgtaagaaaagttcttgcagatatgatcaaggaaggaaagaaagattatgttgtaaagacgtcgtcaatagaagaactccttggtaagagaatatttaatatagatgaagtagataaatttgataaagtcggtgtagtaaatggtatggcatggactgcatatggcggagatacattgccaatagaagcaactgcaatgactggaagtggtaaattacagttaactggtaagcttggagatgtaatgcaggaatcagctaaaacagcttatagttatgtaagagcaaatgctagtagatttggaattgatgaatcattttataaagaaaaagatattcatatacatgctccagaaggtgcagttcctaaggatggtccttctgcaggtgtaactatggtaacagctcttgtatcggctttatcaggtaaaaaagttaagcataatgttgcgatgacaggagaagttacattaacaggaagagttctgccaataggtggattaaaagaaaaatcattagcggcattcagagcaggagtagatactataataattcctaaggaaaatgagaaagatatagataagataccaaactcaataagaagtagtttgaatattatttctgctaaagaagtgaatgaggtattgaagaatgcgttaattggagaggatactaatgagaattaaacaatcagaatttattatatcagcagtaagaagagaacaatatcctatagataatagaaatgaagtagcttttgttgggagatctaatgtaggtaaaagctcaattataaattcattaacaaatagaaaaaagttagctaaggtaagtggaactccagggaaaactagattagttaatttcttcttaataaataatgatttttatttggttgatttacctgggtatggatatgctaaggtttctaagtctgaaaaagacagctggggtaaaactattgaaatgtatttaacagaaagagaacagctaaaaagaatagttttattagtagattcaagacataaaccaactggtgatgatatactaatgtatgaatgggctaagcattttggatatgatgttgttgttgttgcaactaaaagtgataagttaaagaattcggaatttaaaaagaatgaaaaaattataaaagaaactttaaagttaaaagaagaagataaattctactttttctcatctttaaacaaaagagggattgaaactttaatagataatttatttttagaatttgcaacagatatagattaaaagatatataggcaatgaaaagatgaaaacatcttttcattgcctttttatatgtagaaaattatatttatcaaacattagtttataacctactaaataagaaagcgcgtatttaccaaataactttttatattattttataaaaagtttgtataaaaaatgtgtcaaaaagtaatgaggggaatagtatatagtatgaaaaagaaaaaaatatttccaaggaggaataaatatggagatgaatgatatccttaacggtttaaattcatgcgacgatagttctagtgattcagtatcagcagataactgttattgtggaggccagaacgttggaccaatgatgggagcaggcccattaggtggcggattaggttgtggatttggtagttggatttggattttattaatattattctattgtggatgtggcggaaatggtttcttaggtggatctaataatggaagctgcggatgtaattcatgttgtaacaatagttgtggatgcaataatagttgtggaagtaatggaggattatttggtggaatgtttggaaactgcacagcatatctattcttactagtaatcttattcctttgcaacaataataatggtggatgtgcaagtccttacggtgctttagctggatacggtgctaatagtaattgtggttgttagaattctgaatttttaggaaggagagataaatatgtctaaaaagaagaataaatgtggttgtgaaaagaaatgctgctgtgaaaggaaacaggaagcttgctgttgtacaccatgctgctgtgaaacttcatgctgctgtacaaataataatggatctggattattaggaggatgtagtggttccgctgtagcacctattatattcttattaatcgcatgtggatctggattattaaactgtggttcatcatatttgattatcttactatttatactatttggtggatgttttactggagcttctaacggctcaggaaatagctgctgttgctaaaatagtggatggagggttttataccctccaaaaaaatgtgtaaaaacataaacaatttaaatactttatacatatagtggtaataggtaataatattgggagggaaactcatggctaagcataggagaagggaacaagaaccttcaatgaatgataatattaataataataatatgatgaattcaaacaataatccatttggaatcgatccaatgcagcttttaggtttgcttggcggaaactttgatatgagaaatatgagcaatatgttagcgtcaatgaatacaaacggttttaatttaaacaatttaggtccattagctcaaatggcaggattaaatttagataataattttactaatggaaataataatttaaatagaaataacaataattcaaatgtagctacagatatgcaaaatatgtcagccagcaacttaaataaaaatgaggcaaatacacaaaagcatgatgaagtaagagataagaggaataatacaaagatgactcaacaagaacaaatgaaacagaatgaggcagtaacacacacacaaacacagaataaaacaagagatgagaatttagaatttttaatatcattaagaagtttcgtacatcagagtaaaataccatttgttgataggataatagatggatataagaagggattatttaaatagataaaaatagtaaaaaaatatgtatataaatcttatagttgtcaatactataaatgtagtggagaaagcattctcctacaaacttaataaaatactgatattttattaagtaaccccccatcccccttttaggccgcaatttgcggcctttatttatttggatttttgtattgtagtgatcttatattgtgaatgatcttttataacatcaagaagaatacataattcctctttatctccatcctgaccgtttaatttgttcttttcaaaagataacctccattttaaggctataggttctccagaatcattccactcataatcgtagaaaaaagcattttgaaaagcataagaataattatctttatctaaagcccaaaatattgataattcatccttgtttatatcagttgtaaatatgtcaggtagttcatcaagattgtagggaagttcaattaaatttataaaacttaaagtagtatctaaagatggaagattcgtatttgatgttgttgtattaaagaagctattgttaataaccatgaaactattaattgattttgcacctgatgaagatgaaagagaaaaacattgtggtgtttttgtatttttgcagtcaagtattcctaaaatattgctattaccagatgttattaagttgaatttattattattccatccaaaaacataataagtatttttattgttttttgagcccatcaaaattagttctggaatattatttctcgatagatcatgcataaatattttaggtgaccagtgtatattttttgtgaataatattttatcatcaacttcttttgagagataaaaatctgtatttgatgttttaatgttaaaatccactttattttcattgcttattaactgaaaggaatctttagaaccatcccctgttaaatcatattcagtgtcttttgatagatttacaggataaatagcttgcagggccttgagttttgatgattggaaatagaaagtagcacttcctataataaaaatagaaattataaaaatcatatcgattataagctttttctttattaataaaattttcattatgtatcacctccattaattatatgagaaagaaattcttgtgatacataataattaaaattaaaaagactaaaactttaataataattaaaattttagtctgtaagactactggcagtttttgcaataaccataaaagtatactttgttagatataattttatagtcagtattctcttgtgctaaagaatttaaattatctaaattaaacccgtgaaaatcatcaactttaccgcattttagacattgcacatgaggatgtgaacaagagtttccatcatacctaaaattgccttcaccaacgtttatttcttgaaccaatcctacatcaaccaatgtttttaatgctttatacactgtcgctagactcatggtagggtattgtacatgtatgtctgtataaatagcatcagcagatggatgagaagttgtattcataagataattatatactgcaagtctttgaggggttagttttaattttttttccttaaatatagcagcaatttgatccatattaacttacctcacttatttaattgtatatacaaattataacatagaaaaatatacttggtcaatgcaaatcataatgattatccgttgacaatagttataaataattactttgtaactaaattatataattttatatagaaaaaatatctaaaattatataaaaatttaaaactggtatattatttacaaaaaagacaaaaaaatattgtatattcaactaaagtctgctagaatataagtagattaaatgttaataaattaacaaacatttaataatagaagttttattgtatacttttaataatagcctatattaaaatgcaatatttgatggtactaaggaggcgtattttatggctaaatataaagttggagatgaattgataattgttaatgatccaagtaaggataacgaaaagttaaaggaattaactaaattaacagttgatggagattttgcacaaatatcttggggagttaagatattagaagtggagtatgataagcccaatgtcacattaacatacaaaaattgtaatgggcagaagaataaagtttttgcagtttgtagtgatattgataattttgataaagaaaaagtgttagaaaaagcattgcttaaggcattccaaaatgagattattaatatttcatcagtaaaaaataacggacaagtttaatagatctgaaagagcagttcattttgaactgctttttttagttaaaataaaaaaatagtttatgttatctaacatattaaatgtaaaaactttacttttattatgttatgtaatataatgtattcataaattatggggaaaatagtttaagacatgagtaaagggtggggttattatgagtaagtgtccattttggtcagacaaaaaaaataaagttgattgttataaagagtgtcctatgtttataagtgagcatgaggagatgaatgaagaagatcaatgtatttttcatgcatgtgattcatcaacaggaataagttttaaagacattattaaagaggattatagctttttaaatttatcatcatatgatgatgataaattagttaatatttaaaaaatggatttgatcaatttcaaatccatttttttattaagcatcataagaatcagtaaacttatgaagtaaagattgttttaaagaccatagattttgagataaatctacataataagtatgaggattttcaaatcttaatacttcctgccaaagtttatcagtttctacttgtgcaaattctttaatactcattacactaggtgattcatagacacattttcctttttcaaagataggaacttgaagctcttttgtatagtaattactgaatttttttcttttccatgtatgaacaggattaaataatactataggctcagactcgtttatcttttcatctcttagtgcaattaaatcagctaatgctttgtgagtatttttatcgaatagtcttattatttttttgaagccagggtttgttattttttcgtcattttcacttattttaattttaggaattatctcattgtcattttctaatgcaacaagtttataaactcctccaaaaacaggttctgattttgctgtaattagtctttcaccaacaccaaaagaatctatgcatgcaccttggtctaaaacatcttttattatgtgctcatctagggaatttgaaattactatattacagtcttcataacctgctttatcaagcatagatctacatttcttagtaagataagttatatcaccagaatctatacggactccttttggtctttttcctagaggttttaaaatttcattaaaagtttttatagcattaggaataccagattttattacattataagtatcaattaacaatacacagtcatctggatatatttcagcccatgctttaaaggcatcatattcagtatcatataattgtacccagctatgtgccattgttccaacagcaggaatgttaaacattctatctgataaagtacatgcagtagaactacagccacctattattgcagctcttgcgccataaatagctccatcataaccttgagctcttcgtgaaccaaattccattactggacgtccctcagcagctctacatattctatttgcttttgtagcgattaaagtttggtgattaactgttaatagtatcatagtctcaaggaattgagcttgaattacaggtcctcttactgttacgagtggttcgcttggaaatacaggatttccttctggtacagcccatacatcacagcagaaatcaaagtctcttaaatattcaagaaattcatcggaaaacatgttcttattttttaaataattaatatcttcatctgtgaattcaagattatttaaatactcaataagctgttcaacaccagccatgatacaataaccgcctccatcaggaactcttctaaagaacatatcaaaataagcgattttatctttgagacctttattgaaataaccatttcccatagttaattcataaaagtcaacaagcattgtaagatttctctcatctcttacattgaatttagatttattattcataacaatctcctttaattaatacataaaaaatattattttaacaagaaaaaccttgaaaaaataaaatacataagcttattgtacaactataattcttacattacaatatacttgatattttgtagtgtataatataaatcaggattttactttggaattgtataaaatttgtaaagctaaattaaaatggataaaaaattcacaagttaatataatcaatatatttagtattaccacatatgttctcaataacaattaaaataataatttttattatattttggtatgaagataatcatttatataaattaaaaatatggacataatttagggtaatagaagtaagaagacgatttaatttataatgaaagaaaggaatgtataagaatagtggggtataatttagataaatatcagaaggatgcagttgaaacaaatcataaaaatgtgctagttgtagctgcaccaggttcgggaaagacgacagtaataataaatagagttaatcatcttgttaatagattgcatgtttcaaatagcaatataataataataacatttactaaagcagcagcagtaaatatgaaaaagagatatgaaagtgcttataacacaaatacgtcacctttttttgggacatttcatgggttattttataagatgcttttgagaagtggaagagaaatagatataattgatggcggtgtagcgcataaaatagtgagcagcatattaaataagtattttgatgaagttaatgatgacaaaataaaggagacaataaataatatatctatattcaaaacatcaaggcaattgctaaatgaatttaaaccttcaatttcaaaagaaatttttgaagaagcatataatacgtatgaacaatataaagaagaaaataataagtgggattttgatgatttagccataaaaactttagaaatgcttcaaaatgataaaaatcttcttgaaggttataggagattattcaaatacatacttgtagatgaatttcaagattgtgatgaaatgcagatagattttttaaagatgattaatgatgagagtgaaaattctttatttgcagtaggggatgaggatcagtgtatatattcatttagagggtcaaaacctgaatacatggtcagttttgataagatatttgaaaatgggaaaaaacattatttatcaataaattatagaagtaaaaaaatatagtggagaagtctaaacaagtaataaagtataataaagaaagaaataataaagagattaagtggaacaaggataacgatggaattataaagtggttcaattcgtataatgaaaaaattcaaggtgaagctcttgctgacataattgaggaaaataaaaaattaaacattaattatgaagataatgcaatattatacagaacaaatattgaatcaatgagtattatagatgtatttacaaaaagaaggattccattcactttgatagatagagagtacaatttctttgaacattttatatgtaaagatataatttcatatttaaaactttcagtaaatgattttgacaaagaaagcttttttagaattataaataaaccttttagatatgtaagtaaagctaatcttggatatgtaagaacatatccaaaggaagaagcattatttgatatattgataaataaagatgatacaccacctttccaaaagaagaaattagatgaattaaaaaaagatgttcattatttaaataaaatatcattatcatcggccatatcatatataataatggatttaggatatatagatcatatacgtgaatatgctaaaaagataaatcaaagttttgaagattttgaggatataatagaagaatttaagttatctgcagaaggatataaaactatttttgaatttttagcccatatagaagaagttaaacaaagtattgatgaaagcaagaaaaagaaagatagagaaggggtgattttaagcactattcatggggtaaagggtatggagtttaaaaatgtctatataataaatgcatgtgaagatacaatgccacatcaatcaagtaaagaggaaaatcttgaagaggagagaagacttttttatgtaggcataacacgtgctatagataatctatatttattttctccaagaaatagaaaagggcagttcaaggatatatcaagatttatagtagaaggtggttttaacaagcttccaccagatacatatggatataaagtaggaagtgaaataattcataaggcttatggaaaaggaaaaatacttgaacttgatggtgataaagctaagattaaatttagtgataatattgataggagctttagcttaaaagttcttgttgataacaaccttgtaggtaaaactggttaagagagaataaaaaattgtattagtttcattcatgtatttaattaaagattgataggtgaatgaaactatttttatgcaatagaagatgcattaataattttagaagaaatcctaatactatataatgaggtggtgatacaaaagatgaaattaaaaaaaacattaatggttttaataattattataacaatttttaatgttaaggcctatgctactccacattataaatatcagccccatgctgatgtttataaagaaggaatatatcattttcaaaagagtattggaaataagatgacgtttaccctccttacaccagataagtgtatgaatattgtcattattgaaaataatgatataaaatactatattcaattgaatgaaaagagcttgaagtcagaaatatttttagaaaaaccattaaaatttcatacttctattttaattggcgatggagaaatgtcttttacttttgaatgataatcaatgtaattaaaaggaaattttgaatatttgattttgaattatactttgagtataaaactaaattaaatattcaaaaaaattataatagtgagtatatgaatacaaatgataacgaatacaattattaaaataatattttttgtactaagagtacaaaaaatattatcttaatcaacattaattttgatagaattataaaaaaaataatatctatttctataagcattttcatgtgctacaatatcaacatgattttaaagcgcaaaagaggaaggtatttattatgaaattcaataaattaatgtcacttttaatgggagctgcagttataagtagcgtagtcccaacaacaactgctaatgcagcaataaagcttcaagccttagaaggaactatttatgatgcaaaggcttttaaagacggagtatatgtatttgatggttataaaggtgaagaacaagattcagcaatgtacttctttaatggaaaagaagatgttgaaatagaagatgctgaaactatgggaagcaaatatggaatgaactatatcaactttaaggatgatgaaattttatttaatctagtaactggacaagctgaagaagatgatgaagaaactagagtatctatgatggaaaataaatttagatcatcagttataaaaaaagctgatagatatgaagatacaccatatttaattcaagttggaaagattgcagaagatatatttagcggtgtttggtacgaatatgttgttgcaaatagtgatgatttagatgatgcaacagaaaaatacactgtgtatttaagtgattcaggtaaatatgttgatgcatctgaaactttaaatgttgtttattatgataaggatggaaataaaataaatcttgatacttatgaagatgttaaagaaaataaaaatttaagtattgtaaaagaagaaactttgttaatagatgctgaaaatatatataaggttattgctataatggatactgataaattgaaagcaggaatgaatccattaactacatatgcattaaaggtaagtatggaacaaggtgataaagaagatggagcatatataccaaaaagtgttactagctacgaaacatatgatttaaatgcactagaaacaattgaagattatagagcaaataaattaacagctagagtaagtggtaatagtctatatataattaaaacagaagatgattctgttacagtcgatagatatattatgaagaaaataaaagacaaggatagtgttgaaggaaaatctttagataaaagagtacttgaacttgatgaagattttgatgatgttcaaaatgaggatatgcaagattatgatatagatgttcaaggaaatttatgggttcttaataaggggaaagttcaaaagctagaaaatggaaagttagaaacaaaatatacagtagatagaactatggacaacttatctgtatttgctgaaaacagtatgataatttggaatacagacaatgaagtatattcagttgttgcaccacaaaaagctgtagaagaagaaaaaactgaagaatcagtagaaggtacagaatctaaagatgaagtacaaactgtatcaggctggaataagaattcagacggaacatggtcttatactaaagttgatggaacaaaagctaatggatggctaatggataataatacatggtactatttaaattctgaaggtgttatgcaaacaggatggattaaagataaagaacaatggtattatttaaatatatcaggtgcaatgcacactggatggttaaaagatactaatggaaaatggtattatttatataataatggagctatggcatacaatactgtaattgacggttatacattagatgcaagcggagcttggatacaataataattaaatttataactgctttaaatgattttaaataaaatcatttaaagcagtttaattttatattatgataaatttaaatgaaaatagttcatatacaattatttttaagagttctgtctatttctattcaaaatagtttaatattgtatgaagttgtctaatactatataatttaaattagatttactatggaaattagcaataaaggttgtgtaataatggaattaaaaggatttaatcaaaaagatataattttttcgttagatataggtacgagatctattattggaactgttggtataataaaagataaaaaatttcatgttgtatgtgaaaaatatatggagcatgaagaaagagcaatggttgatggacagatacatgatatatctcttgtggcatctgtagttcaaaaagttaagaatgctatggaagaagaagttgggattcagttaaaagaggtatcaattgcagcggctggaagatttttaagaactgtaaattcaaaagctgaactagaaatagatggagaaaatgaaattgataaagaaatcataagaagtttagaattaagtgctgtaaagaatgctgaagaagaaataaattctacaacagaaggaaaattatattgtgttggatattctgttaaaagtttttatttaaatggatttgttatttcaaatcttatgggacataaaggagaaaaaataggtgcagaggttattgcaacatttttgcctagatcagttgttgattctctatattcagtaatgaataaagttaatttaaatgttgttaatcttacgttagagcctattgcggcaatggaagcagctgtacctaaaaatttaagattattaaatatagcattagttgatattggtgcaggaacatcggatatagcaataagttctaaagaagctatttctgcttatggaatggttcctatggcgggagatgaaataacagaagcaatagttcaagagtatctagtagactttaatacagcagaaagaataaagagagaattaggcgttaattcggaaataacgtatgttgatattttaggaatggaaaatgttatatcatcagaagctattttaaaactcatagataatattgtaaataaaacagcagatgaaatatcaaaaaagatattagagttaaatggtgataaatctccaagtgcagtttttcttgttggaggaggggctcatactcctggaatagtgcaatcaatagcagaaaagctaaatcttccaccacaaagaatagcaataaaagatagaagtgctgttgtagaatgtgtgtctgataatgaactaggttcagcaggagtgactgttttaggaatagcgttggctgccataagaagtcttggaaatgattttattgatgttaatttaaatggagaacctataagtttatttaactcccataagcacaatacaatggatgtattgcttcaggcaggaataaacccatcacttcttataagtaaaaatggaaagagtgtaagatttacttataacggatgtaagaggattgtatttggtgaatatggagctaatgcaaagataacaattaattcagaagaagcaactcttgaaactgaagtaaaaagtaatgataatatagagcttgtttatgcacaaaatggtaaaaatgcagaacctaaattaagggataatataagaaatattgattctgtttgtattttcatcgatgatgaaatagtaaatttagaacctgttattcttgtaaatgataaaattgaagatttagaatatataataaaaaatggagatgaagtaagggtatttattcctaatacaatttcagatttaaaaaagtatataataaaagaaaatataaaacttatgagtggagaaaatatattagacgattcttatgaagtacgtgaaggtgaaaggcttacaagatatttagaaattagtgaagatgaaaatttagaagaaacacaaaatgaaaacagtaaggaagacatatctaagcttatagcagctgactcagaagaaattacaattgaaaaatgtgatttagaggataatcataaagataataatgataagatttcagtatataaagaagaatttgatagtataaatgtaatgattaatggtgaacagaaaataatgataggaaaaaatgaatatgtaatagtagatatatttgattatatagattttgatctaacagtacctaaaggaaatattaatattacattaaatggagtaaatgcacaatatacagcaaaattaaaagatggagatgttgtagaagtgttttggacagaataataaaaagtattaaaaatataagtatggaggagtttgttgtggtagattttaaaagagaagcagaaaatataaaagatcagttgataaatataagaagagatttacatgaacatcctgaaacaggatttgaagaagtaagaacttccggggtaattaaagaatttttaacaaaaaataatattccatatatagaagtagcaaaaactggagtttgtggaattataaaaggaacaaaagaaggtaataataagactatagcattaagaggagatattgatgctcttccaattcaagatatgaagtcatgcgaatttaaatcaaaagttcaaggaaagatgcatgcttgtggtcacgatgcccatacaacaatattaatgggagctgcaaaactgttaaatgatcataaagatgaattttcaggaacaataaaattattatttgaaccagcagaagaaactacaggtggagcaccacatatgataaatgaaggtgttttagataatccaaaagttgattgtgttttaggtcttcatgtagatgaagaaacagaatgcggaacaataaaaataaaaaaaggtgtagttaatgcagcatccaatccttacactattaagataacaggtcaaggtggtcatggagcatcaccacatactacagttgaccctgtagttattgcaagtcatattgtaatagctcttcagactatagtaagcagagaaatagcaccagttaatccagcagtagtaacagtaggtacaattcatgctgggacagctcagaatataataccaggtgaagcaacaattagcggtatgataagaaccatgactaaagaagatagagcatttgcgattgagagacttactgaaatagcagaaggtatagcttctatgtcaagagcaaaggcagaagttaaagtagatgaaagctatccatgtctttataatgaagataactgtgttgatttattaaaagaaagtgcagaaatagttttaggaaaagaaaatgttttagagcagaaagcacctaaaatgggagttgaaagctttgcatattttgcaatggaaagagatgcagctttctatttcttgggatctggaaacaaagaaaagcagacaacagaaccagctcatagtaacttatttaatattgatgaagactgtcttccaataggcgtagcaattcaagctactgcagcatataattatttgactaaataattataattgacaatgttataaaaagactacataatgctaagaggatagacaaaagaaaagttgaaggttgaaaattgatttatatcatacactttcaattttcaactaatttggtaggagtgattatatttgaaaatagaaatagggtcaaatgaagcaggacaaagacttgacaagttcttaagaaaattattaaaggatgtacctttaagtgcaatatttaaagctttaagaaaaaaagatattagagttaatggaaagaaacagaacgaaaaatattttcttgaagaaggcgacatagtagaaattaagtacatacaaagcaaaaaagaagataaaacacaaaaatttataaaagtagatcctaaacgtatgaaaatatgttttgaagatgaaaatatggttattgttgaaaagtggcctggaatacttgtacattcagatacaaatgataataaggagcctacgttgactgactacgtactttcatatttaaatgacaaaggagattatttaccagaaaatgaaattacatttacacctgcagcttgtaatagattagacagaaacacatctggtattattatgtatggaaagacttttgaaggcttgaaatgtattaatgaagctataagagaagatgaagtaaaaaaatattattatacattagcaaaaggaaaagtaaagagtggactatacgagggatatatagttaaaaatcctgaaactaatatatcaactgtatatgataaggaagttaaaaattcaaaaagaattgccatggatgtaaatgtagtagaaactaatggtgcatattctttcgttgaaattaatttaattactggaagaagtcatcaaataagagcgcaccttgctcatgttggaaatcctataattggagacaataaatatggagataaaaaattaaattcattctttgaaagcaaatatggtttaaattatcaatatttatatgcgtacaaattaaactttagaaagataaaaggtaagcttgagtatttagacaacaagacgatagcagtagcgttacctccattattcaaaaaaataaaacaagatgcatttaaagtttcatttagataggaggtaattatggaagagaaatcagccaataaaggctttttaattctttcaatagccggaatcgtaagtaaaataatatcagttttctatattcctcttcttcagagaatattaggattaagtggatatggaatatatcagaattgttatgaagtatttttatttgcatatgctataactaatcttggaacccagccagcaatcgcaaaagtcgtggcagaactcacagcactagaaaaacatgaagatgctgtaagaacattaaaaatatcaagaacattattagctctagttggaggtataatatcaataatactaatgatgtgtgcattccctataggaaatcttatagggaatccagaagcatcatatggaatacttcttcttgcgccaagtatatttattacatcaatattatcttcatatagaggatatttccaaggtaaaagtagcatgaatgcaatagctatttcacaggttgttgagcaggtaataaatatattagtgagtttaacatgtgcctttttacttgttaaaataagtattgcatatggtagcgccggtgggacaataggtacttcaataggggcacttgttgcatgtctttatatggtatatgtatatgataagaagaactttgaggaagacgctattgaagctcaaggagataaaaaaagggtacgaagcaaagtaattgtaagaaaattaatcaaatatggacttccaataactttaacagccggtcttcagaatttcggaagtcttgttgatatggtaaatgtaaatagcagactagctcatgcaggatttacacttcaaaaagcacaggaactttatggtgttttgggaagatataaaacattgttatcagtgccattaattattgttactgcattaggtacaacagttctaccagcagttgctgcagctatggcattaaagaataaaaaggatgtaagaaagagaacaggctttgcttttagagtgacatttatagttactattccagcagcaataggactttcatgtcttgcaagtgaagtttttgaacttctttatggaacgagtcaggggtatgagcttatgatgataggatcaattgtacttgtgattcaagctatagttcagatacagacaacaatacttcagagtatgaataagctttattttgtgttatttacattctctttagggatagttgcaaagataattgctaattttgttcttgtaggaataccaagtattaatattttgggagtagttggaggtaatttcctttggtttcttattcctatgatattaaatcagatggcattaaataagaccttaagaatgagaattccgttttttaaacatatgcttaagccatttatatcttcattagctatggctggagtactatttgtgcttaaacagcctgcaagtataattttatcgataactaatggcggaaaaatattaagcggattaattacaataataataatatctattggaggatttgtgtatttatacttaatgataatccttggtggattaaacaaagaagatatggatagtatatcaggaaggatatacagaattcttccacgttttatgcgaaagagaatgagatagaaaatataagataaggatgtatcttaaaattgatacatccttatcttattgttattctgtttcgccaaaaccaccaagataagcaaaaattaaaaatgttattcccattactgcaaaattatttgcaattggaaaataagctgaaaaatgctttgaaaaaattgaaacaataataaagactaataaaccaagcaaaagataaattattacattatatgggtttatattaatatcaatatgtttctttacttcatgtatatttagtaaaaaactaatactacatgctatacacattgtaatgctatagccaaatatgtttatagaatgtatagaggtaaatatatataagcagattaactcagttacagcttcaattaatgaatttctcagtataattccttgtctgtttaaaccattaagaattccgaacatagtaagtgatgtaaagattataggtgcagaaaaagatgaaaatcttatataacttcctaagtcatcgcgtccaaaaaacatttctccaagattaacaggaactacattacagattattgctgttgcaagacctagtaaaaatgctagtttaattacttttcttattctaagtgatgcttcatattcctttccctgattaagagtttgtgataaatctggtataagcagagtattgatggttgaaacaacaatcatgggtatagttattatacatattgccattccattatattttcctatcatacttaaagcttcagagtaatcaaatccagctgaaataagtcttcgtggaactacaagtgttgccagggtgccaagaatattagtgagaaaaccattcatgcataatgggattgaaatacatataacatcaaataaaagctgagagctgctttcaggtctttcaaaggaaaccggcattttttttattgaatatttatagtatatatacaaaaagaaaaggctttggaattctcctatgcataatgcaactgtagctagcgtaaccataccctctaaagtatgtgcctgagtcaaaaagataagcaagctcacagtcacaattctcatggctttttcaaatatatctataatagccggcactgtaattttagaagtaccataaaaataccccttaaatatattagaaatagcaatacatatcatggcgggacatattactcttatggcacttatagttcttgtgtcatttactccatatttgccgataaaaggtgcagatgaaaatacgataatgcctataaatagtgcccatactacattaaatatggtaacaactcgtatagtttttgttatattattatgttctcctctttgagaataaacagctgaaatttttgaaattgaagcaacaataccagctgacataagacatataaataaattgtaaataggcataacaagattatatagtcccatgccttcaggacccaatatcttagaaagataaatggaaaaaataaatcctaatatacctgtagctatattagacgatgttaacaaaaatgaatttttaaaaaaattatctttatccaaagttactcactcctttgattaatattatgatttggaagttagaaaaattctaaatattgtaatgtaaaataaatttcaatatataataaggtcttattttacatatatcaaaatataatctaataggaattgattttacacattatgtttaataatatatgtgaggttttgagatggggtgatatattgtgaagcgatttttgaaatttgtaataatttcaatagtaattgtagttacagcatttattttggttgagatatcaggtaaatataaagttagtatattaagaaataatgtaacatggagtatagataataagaactgtaagcaggcatctgattttgataaggatgaagatggtaatacatatgttgcttataaggactctataaaaattatgaggggagaaggaacagaagatatactatttcaaaatgattctttaaatatagaaaatatattgttttataaaggagtaatatattatctttccaatgataagatatatagatatgatatttctaaaaatgaaagtaaagttgttttagaaggtatcccgtttaaaggaaagtatcttgatagaaaattacttattaaggattctaaattgctattagctataggaagtgcaactaactctggggttgcagataatgatggaacttttaatataaatgaaataccatatgacactagtcctataaacataacattgacaggaaataattatggagaaaagaaaacaggagcatttatggcttatggaaactctagtcttaagggtcaaaaaatagaatgtaaaaagattgcaaacagttctataattgaaatagacccagagactaataaggtttctctttttgcatgtggtataagaaatattactggatggtctttagatagtgataataatcttatatgtataattggtggcatggaggatagtagtgacagaccggtaaagagagattttgattatttatataaaattgaaaagaacaactggtatgggtggccagactttagtggaggagatccaattgattcaccacgtttcaaaggtgacaagcctataacaaagataattgaaaatcatcctaacaaaatagttcaaggaccactttttcaatttgatgaattaggctcaataaagtatctttctatagatactgaaggtgcaatttttgaaaaggatactggagtctattatgatgaaggaaaaaatatgatctcatcaattactaaagattctgtagttaatagactcttaaagttaaaagatgatagtattgtaaaagaaataaaaataaaagataattcagtgtatattcttgatagtggaataggatgcatatataaattaagttcaaatgatggaaataatatatttaatttacctagaagtgtacttatatttataatggtattactaggaatacttgtttttatatttatgtataagtataattcaaaaaataattaattgatactatgaagatttattaaatctgccatgttgttattttggcagattttttattctttaaaggagtaatattttttatagttagatttttaatatatagtctataacatagtttccttggagagttttatctgattgaaataaagacaaaatataaaaagacattttaaacaatgtaaataaatggtaaaattaattgtaatatattatattaaaaaatttgaaataaagggtgatgaaaatgggaaaaacaattattataaacttagagaaggttaacataagtggtgatgtgttagacgttggagaaaagaatcttggaattatttataatttaaccaaagaagctcaggaagaaatgagccttgattatgtgaattctgaaagtaaaattcaattaaaaaacagagaatatgatgcatgtacttttttcttcgaattaaacaaggtatggacatcaatagaaaaagaaaaaattattaaggaagtttataaatatataaagcttggcggggaaatattaatatgggatattaataaagaaagaggaaaagtttttaataataagataaaagtaatacttccaaaaagtaatataaaagaatttaattttaaaaatttaaatgtaattacatcatcaaatatagaagaaacaaaaaaatccttgaaaaatacttcaatatagaagaaactaaagcatgggaagatatttttttcttaagagggaaaaaattagagacaaatgttaaagaagaggagaaaaatgaaaatgaaggtgttacttacagcgattaactcaaagtatatacacagtaatctggcagtacgatacttgagaagttttgcaaaagatttagactacgagggtgaaataaaagaatttacaattaacgatagagaagaaagaattcttgaagagatcataagagaaaagccagatgtagttgctttttcaacatatatatggaatgttgagatggtctcaagaatttctaatttaataaaaagagttgattccaatatagaaattttatatgggggacctgaagtttcttttgattctagaacatttttaaaagaaaatgttggagaatatgttatagaaggagaaggagaaaaaacatatagggattttatattgtataaactagggaaaatggaattgcaagaggtacgaggtttacactataaaaataatgaaactgtatattcaaatgaaaaaaggcctcttatggatatggatgagattatttttccatatgaaactgatgaggatcttagtaataagatagtgtattacgaggcatcaagaggatgtccttttaattgtaagtactgtctttcttcaacaagtcatggtgtgagatttttaaatattgatagagtgcgtaaagaacttaaatattttatcgataaaaaagtgagacttgtaaagtttgttgaccgtacatttaattgtaatcataaatttgctatggcaatatgggagtttttaataaattcagatacagagacacaatttcattttgaaatatccgcagacatattaaaagatgaagaaatagaaattctttcaaaagcaccagaaggaagatttcaatttgaggttggagttcagactacaaatgatgaagttcttaggaatataaatagatttgttaatttcagtcatataaaagaaaaagtagaagaacttatggctataaaaaatataaagcaacatttagatttaattgcaggtcttccaggagaagattatatatcttttaaaaaatcatttaatgatgtatatagtataagaccagaagaaatacaattaggattcttaaaattactaaaaggatcgtctatgagagaagaagctaacagatatggaatggaatattcaccatatccaccatatgaaatattaaaaacagatatggtaagttatgaagaaatgcttaagttaaaaaaagtagaagaaatggttgataaatattataattctgggaaatttaattacataataaaatactttgaaaacaaattccatagtccatttgaattctattataaattaggagtatttttcgaaaataagggatattttaataaaaatataggaaatatagaatattataaggtatttttagattttaactatgaaattttaaaagaagataataaatttattaatgaaatagttaaatttaattatttgttatataataagaaaagagggcttcctgactttttaaggagtaatatatctaaagaggaagaaaaagcaataaaatcgtctcttcgtgaaaaatattcatttaaagaatatcatttagaaaaattttgtattgatttggaagagtatgtcaagagtgggcgtataatagaaaaagaatgctattatttatttgataactttggtttatacataaatattaatatgtatagacaagtttaaagaaagttaacatagtcttaaactatagtaaaatcaataaaactattaaatttaaacaaggtaaatataatggttgtattctttttaggttaaaattgttgaaaaatatacatactgcgtgtataataaaacaagtacaaagtaattaatactatataaagtattaatatatattattttcttttttacatttacattgaaggcattaaaggtggtgatattttggcattagaagcaattgaagaaatcaaacaaactgaagccaaggctaaggatattgttaaaaatgcaaatgctgaagcaaaagaattagttcaaaaagctatagttgaagcagaaaagcaatataatgatgttttagctaaagcaaaagaaaaggctgataagcttataaacgacgcggttaatatgggggataaagaagcagaacctatattagcacaaggcagaaaagaagctgaagatatatcaaatgtatctgaagacaaaaaacttaatgctgtaaaattagtggttgagaggatagtgaaagttcatggcaatagttaaaatgaataagttcactttgttagcctttgaatcaaaaaaggaagcattacttgaaaaacttcaaggtttttcaagtgcagaattcatagatcttcaagatgaaaatctattagaagataatgaacttcttcaggatttaactaaagatgtagttgattctgatatagcaaagtgggaagagcaattatcaaaggttaaatttgccctacagtttttacaagactatgtgcctaaacaatctatgcttcaagctttacgtagcgaaaagctttctttaagtttaagtgaacttgaagaaagagttagctcaagcagatgggaagctatctacgacaaggttaagtcaaaagatgatgaattaactaagttagacaatgaaaagacgaagttacaaggtatcgtacaaagtttacaaccatatgagaacttcgatgcgcctttaggttcattaaaagaacttgaggaaactgtatatttcttaggaagtgttgcaaatcaatatgaagaagctttaaatagcgacttaaatgattgttatcttgaaatcgtatctaagaataatcaagatacatatttctttgcgttatgcaataaagataatgctgaaaatgcagctgaaatactaagagggtttggatttactccttttaaaactgaggaagaagatactcctctaaagctaattcatgattcaaatgaaagaatttctttaattgaatcagataaattcatcataaaagaagaattagctggatatgatgatgaattaaaaaaattacagttagcttatgagtactataacaacctagttggaagaaaacatgttacaaataagttcttaaaaactgagagtgtttcattaatccaaggttgggtaccagttaagcacaatgaaaagtttactaaaatagctgacgaagttttaggagcagattattacctaaactttgaagatgtaaaagaagaagaaattgatgatgtaccaatagcattagaaaataatgacttaaatgcagcatttgaagatgtaacatcaatgtatgcattaccaaagtacaatgaagttgaccctacaccagtagtggcaccattctacttaatattcttcggaatgatggtagcagatatgggttatggacttcttatgttaattggaacaatacttgcacttaagttctttaactttgaggatggaatgaagaaaatggttaaattcttccattacttaagttatcctacaattgcatttggtgcgatttatggatcattttttggagacttattccctaacttacctagattattaaatacatcaactgacgttatgtcaatacttactttatcagtagtatttggtgctattcaaatattctttggattaggaatgaaagcatatgtattatgtaaacttggtagaccattagatgcattaatggatgctggatcatgggctcttacattaatctcacttggattaatggcaggtggaatgttccttgaaataccagtacttaaaactgttggtatagcaggatctattataggtgcattatctattgttcttactcaaggtagaatgatgaagagtgcaggtggtaaggtaggtcaaggtttatatgaattatataatattacaggatatgtaggagatttagtttcttatacaagacttatggccataggattatcaggaggatctattgcaggtgctgttaacatgattatgagcatggtgccaggtccaattggagctttcttagtaggtccattaatatttgtaatattccaaacagtaaacttattactatcactattaagtggatatgttcacacattaagattaacttatgttgaatatttcggaaagttctatgatggtggcggaaaagcctttaagccatttgaaacacaaaatgaatatattaatttaacaagagagtaggaggattttaaaatggaaatgagttggattaactatttcgtagaaaattttggaggaatggtgttcggagcactaggagttgcagttgcagtaggtatgtcaggtataggatcagctaaaggtgttggtatcgttggtcaaagcgcagcaggtttattagcagaacaacctgaaaaattcggtaaagcattagttcttgaattattaccaggtacacaaggtctttatggattcgttattggtttattagcattcttccaattaagtggagatacttcattagctcaaggtttatacttattatttgcttgtttaccaatcgctataactggtttatggtcaggtattgctcaaggtaaagcttcagctgctggtattcaaatattagctaaaaacccagaacacacaactaaaggtatggtattagctgccatggttgaaacttatgcattattaggattcgttgtatcattcttattagttaatgctgcaggaactatcgcatagtataaaaaagcttagtagtattaagatgaggatgtgaggtaatgtctaatttaaataatttaacttctaaaatcttacaagatgcagaagctaaaaaggcagtcatcttaagcgatgcagagaatgaaaaaaataaaattcttagcaagaagcaacaagaagctagctcagttgaaaaaactatgctagaaaaggctgaaatcgaagctgcatctagaaaagaaagaataatttctggagcacaattacacgctagaaatgaaaaattagaagcaaaacaaaaagtaattagtgaagtttttgaaacaagtgttaaagaactttcaaactgctcaggtgaggatttaaaaggctttgttaaagaagtgattttaaatactgaaatcgaaggtgaacaaaaccttatattaaatgcagaaggaaagaaagttattgatgatgcctttgttgctgaaatcaataaagctcttgataaaaaagctgtgataaaaatagatgaaaacactcgtgattttagaggtggattcatattagaaaaagatggcatagaaataaataatacttttgaagctttggttagttcaataaaggatgatttaagtctagaagtagcaagagtgttgtttagttaaggaggttaactaatggatgagatgcaatttagtcaagttatacctagacttagagtatacgagacaaaactccttgataaagcaaaaatagacagaatgatagattcacattctgctgaagaaactttaaagattcttcaggaaacagagtatgccaatgttatgacaaatgttaagagagcagaggactatgaagtaatattaggtggagaattaaaaagattatttaccgtaatgtatgaaattagccctgtaaaatctctagttgatttaatgagtattaaatatgattatcaaaatataaaagtaattttaaaaggaatgtttcttaaaaaggacttatcatatcttttaattccagttggaacaatagattgtaatgaattaaagaacattatagaaaatgacaatctttcagatttacctcatttaatgagagaagctgtagaagaagtacaaatatcttttgaaaatactaatgatccacaaatgattgatattatattagataaatttatgtttaaatcattagtagaaatcaaaaaagagattaatgataactttgttaataaatatgtagatgctttaatagattctacaaatttaaaaactcttttaagagttaaaaagcaaaacaaaggtagagaattctttgcttctgttattattgaaggaggttctatagataaagataagttattaggtatgcttaatgatgcagctgaaaacatatcaacaaagcttacgtatactaattatgctgaatttattagagctggtatagagtattatacgaagactggttctgtaagtttattagaaaagttaggcgataactatgttatggatatgatgaaagatgcaaaaataataccatttggtgttgaaccattactagcttatatttatgctaaagaaacagaaatcaagattattagaatcataatggttggcaaactcaataatatttctgcggaagtagtaagagaaaggctgcgtgatatttatgtttaagaaaataggtgtagttggagataaagactctgttttagcattcaaagcacttggaatagatgtatttccagttgttgagcatgatgaagcaaaaaagactatcgatacattagctagaaatgactacgcagttatcttcgtaactgagcaagttgcacagcatattgaagaaactattgaaagatataataaagcagtacttccagctattatattaatcccaggcaatcaaggatcgcttaatataggtatgcagagaatcagcgataacgtagaaaaagctgtcggcatgaatattttatagaaaggtaggttagtaatttgaagaccggaaagataattaaagtttcaggacctttagtagttgctgaaggtatggatgaagctaacatatatgacgtatgtaaggttggagaaaagggacttatcggtgaaatcatcgaaatgagaggcgataaggcttctatccaggtttacgaagaaacttcaggaataggacctggggatccagttactacaactggagaaccactaagcgttgaattaggaccaggacttatagaatcaatgtttgatggaatacaaagaccactagatgcatttatggaggctgcacagtcaagcttcttaacaagaggtgtttccgttccatcattaaacagagaaaagaaatgggactttgtagcaactgctaaagttggagacgaagttaaagctggagatgttattggaacagttcaagaaactccagtagttgaacaaagaataatgataccagttggtgttgaaggaaaaattaaagacattaaagctggtagctttactgtaactgaaacaattgctgttgttgaaactgcaaaaggtgacagagaagttcaattaatgcaaaaatggccagtaagaaaaggtagaccttataattctaagattaatccagttgagccaatgcttacaggacaaagagttatagatactttcttcccagtagctaaaggtggagcagctgctatcccaggtccattcggagctggtaaaacagttactcagcatcagatcgctaaatggggagacgctgaaatagttgtttacgttggttgcggagaacgtggtaacgaaatgacagacgttgttaatgagttcccagaacttattgaccctaagactggtgaatctctaatgaagagaacagttcttatagctaatacttcaaacatgccagttgctgccagagaagcttcaatatatacaggtatcacaatcgctgaatacttcagagatatgggttactcagtatcaatcatggctgactctacttcaagatgggcagaagcattaagagaaatgtctggtagacttgaagaaatgcctggtgacgaaggttacccagcataccttggttcaagacttgctgactactacgaaagagctggtaaggttgaatgtttaggtaacggtggaagaatcggttctatcacagcaatcggtgccgtatcacctccaggaggagatatatctgaaccagtatcacaatcaacattaagaatagttaaagtattctggggtcttgatgcacaacttgcatatcaaagacatttccctactattaactggttaacatcatattcattatatgctgatacaattgataagtggatgaattcaaatgttgctgataactggggagctttaagattagaagctatgactatccttcaagatgaagcacaattacaagaaatcgtaagacttgttggtattgatgcattatctgaaaaagatagattaaaattagatgttgctaagtcaataagagaagactatttacaacaaaatggtttccacgaaattgatacttatacatcattaaagaaacaatataagatgttaaaccttatattaggatatagaaaagaagctgaaagagcattagaagctggagtttacttaagcgatataatggctatggaagacttaaaagatagaattgcaagaagtaagtacatacatgaggatgaactagataagatggatcaaatctctgtagacttaaaagaagcaatggataacctaataagcaaaggaggggtagcaaatgcttaaagagtatagaacagttacagaagttgttggccctttgatggttgttgaaggtgttgaaggcgttaagtacgatgaactagttgaaattgaacttcatactggtgaaaaaagaagaggtaaggttcttgaaataaatggatctaaagcaatggttcagatattcgaagggtcttcaggaataaacttaaagggtactaaagctaaattcttaggtagaccacttgaacttggtgtatctgaagatatgttaggaagagtattcgatggtatgggtagatctaacgataatggcccagacataattcctgaaaaaagagttgatattaacggtgaagctatcaaccctatggctagagatttcccatcagaatttattcaaacaggaatatctgctatagatggacttaacactctagttagaggacaaaagcttcctgttttctcagcatcaggacttcctcaccaagagcttgctgcacaaatcgcaagacaagcaaaagttttaaattctgattctaagtttgccattgtattcgcagctataggtatcacattcgaagaagctcaattcttcgttgaagaatttaaatcaacaggtgccattgatagatcagttctatttatgaacttagcatctgacccagctatcgaaagaatagctactccaagaatggcattaacttgtgctgaatatttagcatacgaaaagggaatgcaagttcttgttataatgacagatatcactaactatgctgaagcattaagagaaatttcagcagctagaaaagaagttccaggaagaagaggatacccaggttacttatatactgacctttctacattatacgaaagagcaggaagattaagaggtaaagaaggttctatcactcaaattcctatacttacaatgcctgaagatgataaaactcatccaattccagacttaactggatatattacagaaggtcaaattatcctttcaagagaattatacaagaaaggtttaatgccacctatcgatgttttaccatcactttcaagacttaaagataaaggtataggtaaaggaaagactagagaagaccatgcagatactatgaaccaattatttgcagcatattcacaaggtaagcaagcaaaagaattatcagctatcttaggagaatcagctttatctgaaactgataaaaaacttgctaaatttgctgaagcttttgaagcagaatacgtttcacaaggtttcagtacaaacagaagcattgaagaaactcttgatttaggatggaaattattaaagatgattcctagaactgaacttaagagaatcagagatgaataccttgaaaaatatctgccaagagaggaagaatagtctatggctaagttgaacgtcaatcctactagaatggaactctctaagcttaagaaaagacttgcaacttcatcaagaagtcataaacttctaaaggataaacaagatgaattaatgagacaattcattaaccttgttaaatataataataaactaagaaaagaagttgaagataatcttcaaggatctttaaaagatttcgttatggcaagtgctgtaatgagttctgaattcttagaagaagctattatatatccaaaagaaaagatttcagttgaagttggagaaaagaatgtaatgagtgtatctgttcctgtaatgaacttcaagagacaacttgaaggagatgaaggaagtatatatccttatgggtttgcaaatacatcttcagaacttgacgatacactttcaaaactttatggaattcttccacaattactagagcttgcagaagtagaaaagtcatgtcaattaatggctgacgaaattgaaagcactagaagaagagttaatgctcttgaatacatgacaatacctcagcttcaagagactataaagtacattagaatgagactagacgaaaatgaaagatctgctacaactagattaatgaaggttaagagcatgattgaacaaagaggctagatttaaatattgaagataggtaattatatttttataattcataagcactatcttatatgaaagagcactgtaaaatgcagtgctcttttattatggtttacttattagaaaactattacaatatattacttatactaatataatttgaaattagatataaccgttaacattgagagtacaattatggatgcatagaaaacaagaacatgaattattttttctacaatatacacatttattttgcgaagtactgtaaacagcaacaacatactcgccagcatcaatatttgaaaattcatattctcccttagaattagttaatgtatattctaaaggattagatgcgcaaattgaattaaatagataaacttttatatgactggttctacatggatattcgcaacagtatatagtacctttaatacacactttgcaaggttttgtacaaaaaacaggagcattagtagaagatggagtgttaggagatgtaggagtagtgtcagtattaaaacaacagttactgttttgaggaaggtttcctttaaatgtgtaatcatgaaattccattccaccagtaagattaaagctaataagagtcccctgtaggtttccattatctaaataacaattagcattaggtgcaagtacagtaccatctatttgaacaccagaggcagtgaactttgttgcatctgaaaaattccataatatatgctttatttgatttggtgtaggtggattactattgttaactatagttgcagcagatggaaagtgaatgaagtctcccgtaacatttattattaatgtagagttttctggaaaaagtagcagtatttcatttgtagttgacaatatatttgaaggtaaagttacaatattcatatcagaatctttacctgtaattgttagctgtcctccagaatttaaattataagatgaatttgtactgtattttcctaaaaaatcagaataacattttaaatatgaagatacagaagaaaaatctataggtttatcttctgtgggtggtataacactaccattataatttgtcatagtataatgtataacatttttactattacttataattgtagttccattatttgaaccgctttcgatatctattttaccaccaacaattagatagggtgaatcttcttttggaagatggctagcaacactgtagtcatttaatagaatatttccaccaacagctacttttccctgagaatctgtaaattcagcagaataattatttaaaataaatatattgaaatcattagcaccatataaatctttacattcgtacattactttatccttcctttgtttacttagtatacttatagtatattaagtaaacataatatttgttaaaggttatagatattaaaaaagcaacagcataatgcaatgataatatttttcgttttttttgatgatattaaataataaactcttaaaaattagtattttagttgaaaatttattagataagtatatagatttaataattttgtaattgatatactatattattaatagtataatcaaatgggtagaaaactcaaaatgttataaaattatgatgattttaactaaggagtagagaagatgaattatatattagcaatggtaattgcattattattttcaatgattaccatgccagttcttatgaaactgtctcataaattagaatttacagataagcctaataagagaaaaaagcataaagccccaacacctttatgtgggggaattgcattatatataggattttttgtttcgtattttttatttgttagagatgacatgaagcagcagatagtcatatttataggagcaacattaatagtaattattgggcttgtggatgattattataaaacaaaaggaaaagaatttcctatttttcctagacttataattcagttattagcagctgtattagtatttaaagcaggaatattttttaaaggatttactaatccatttacatctcaatttattctgcttagtggaacaattcagtttattcttacaataacatggatttttggtgttactacagtcattaattggtctgatggtaaagatggtcttgcaggcggtttatcacttatttcagccatgactttctttgtagcagcacttatattgggtcagcaggatccatctgctatggtatctataatactatctggaagtatacttggctttttgtattacaataagtatcctgccaaggtttttatgggagactcaggagctaatttcttagggtttattttaagtgtaacagctttggatggagcatttaaacaggcaactgtattgagcttgttcattcctatcttggcacttgcagtacctatatttgataatttatttgttatatttaaaagattttcagagggaaagccggtttatcaagcagatagaagtcagattcattttagactcgaagaaaagggattttctccaaaacagatagttaactacataatgctgataagtttatctttcagcgtgctttcaataattttacttttaataaaaagataaaatttcaatatttttctttacaaaattaaggtaaagatatataataaatgcaataaatacaattagaatacttatcaagagtggtggagggactggccctgtgaaacccggcaaccaatatttattagatgatatgaggtgccaaatcctgcagtttttatgactggtagataaggtaattttagaaagcttcacgcctaaggaatacctttaggcgtttttgttatataaactaatttatttattgtaatataactagatttgaagagaataagtatggaggaataagcaatgagaaaatatgaagtagaaagtgttaaattatatgtaattattaaccaaagaagttggtgataatatgagtacatttgaattaaagattaacaaagaagaagttcttagatacttggggtataaaggtcaggaaatagatgaaaaaatggatcatatgattaatactagtagagaagaagttaaaaatataataacacctagagtattatatgaatataaaagtatatccaattcagaaaaaggaattgaggtatctggaacgaatttaatattgccaggaaatgatattaaaaaacatttaagtgcttctaatgaatgtgttcttatggcagtaacactaggaaacgaaatagaaaagaaaacacgtttgtatgaaaaaattaatcttacgaaagcacttataattgatgcatgtgcaactaccgctgttgaagaggtttgtgatattgtagaggaaaaaataagaaaagaagctgaagaaaaaggtatgaagataacttttaggtatagtccaggatatggggatcttccacttgatattcagaataattttttacgtgttttagatgcgcagaagaaaattggattaatggtatcagaaaataatcttttatttccaaggaaatctgttacggcaataataggaatagtaagtttagatgctaaaataaataaaaaaagttgtgaaaactgcagtaattacaagaattgcagtttcagaagagaaggagaaacttgtggggcttaaagaattaataaaagaaaagatattgatatttgatggagcaatggggacaatgcttcagaaaaaaggcttaaaaattggtgaaaatccagaaatattaaatataaaatcaccagatataattgaagaaatacatagagagtatatagaaagtggagctaatgtaataacaaccaatacttttggtgctaatgaaagaaagcttaaactttgtaatctagaagttgaagaagctgtagatgcagctattaatatagctaaaaaggcaagaggtgaaaaagaagtatacatagcccttgatataggaccaataggtgaacttcttgagccaatgggaacattaagttttgatgaagcttatgatatatttaaacgtcagataattcaaggtacaaaatcaggagcagatgttattctttttgaaacaatgacagatttgtatgaacttaaggcagctgtacttgcagcaaaagaaaacagcagtcttccaatactatgtacaatgacatttgaggaaaatggaagaacatttacaggatgccttccagaggctatggtattagttcttgaaggacttggtgttgatgcattgggtgtgaactgttcattaggacctaagcagcttaaaccagttgtagaggaaatatgcagattatcgaatatacctgtaatggttcagccaaatgcaggtcttccaactttatcagttaataatgaaacaaagtacgatgttactaaggaagaatttgcagaaactttatgcagttttatagatagtggtgtaagtataataggaggttgttgtggtacgacacctgattatataagagaacttgtaaaacgaactgatggtaaaagtattctaaaaagagaaaagaattattatccagcagtatgtacaccatcaaaagttgttaaaattgatggtataagaattgttggagaaagaattaatcctacaggaaaaaaattatttaaacaggcacttattaatgatgatttagattatatattaaatacggcagtagcacagacagaagcaggagctcatatacttgatgttaatgtaggtctgccagaaataaatgaaccagagatgatgcagaaggtggttaaggaaattcagggaatactggatattccacttcagatagattcttctgataaaaatgcaatagaaaaaggcttaagatattataatggtaagcctatattaaattcagtaaatggtgaagataaagtattggaaaatatacttccaatggttaaaaagtatggagctaatgttgttggtttaacattaagtgaaagtggaatacctaaaaaggcagaggaaagatttgagatagcaaaaaaaatagttgataaagcggctcaatatggaataaataaagaaaatgtttttatagactgtcttgtacttacagtttcagctcaacaggaagaagttcaagaaactttaaaagcagtaagaatggtaaaagaaaaattaggagttaagactctactaggtgtttctaatatatcatttgggcttccaaatagaaaacttataaatgaaacttttttagcactagcacttgcaaatggccttgatcttcctataatgaaccctaatgaaagtgggatggtaagggttatagattcctacaatgttctttataattacgataagggatctgaacattatataaagaattatgctaatgttacaatagaaagcaatgtagagataaaaaatgcagataaaacaaatataataaaatcacaatcagaaaatagtgaaagtaatttaaaaagtattgtaataaaaggattaaaagaagaggctaagtctgcaacaactaatttgctgaaaaaatatgaacctctaactatagttaatgaatatttaataccagctctagatgaagttggtgataaatatgaaaagggagtgttattccttcctcagctaatacaagcagcagaaaccgtgaaaaattcctttgcagtattaaaagctgaaatttctaaaaataatcaagagacaatatcaaaaggaaaaataattgttgcaacagtcaaaggtgatattcatgatataggtaagaatatagttaaagttatacttgaaaattatggatatgaaatgattgatttaggaaaggatgttccaattgaaactgttgtaagtgaagcaaaaaaacacaatgtgaaattaataggattaagtgctcttatgacaactacccttagaagcatggaagagacaattaaagcgttgaaagaagatggatatgagggaaaggtgtttgtaggtggagctgtacttacaccagaatatgcggatgcaataggtgctgatttctatgcaaaagatgctagagaatcagtggaaattgctaaaaaagtactatcataataaaaatataatagaaagctgttttaagacaaataagttttaaagcagctttttattattgtatttttagttattaattaccttattaacttaatgatataacatctaaatcatcaggaacaaatatagttcctttaaattcttctttaccttcttttatgtataattcttttctttgaactaaatttttatcctcagtgtgatataagataatgttttttacatttaatttatcagcatttatgcatgcatcctttgcagttgcatgatgcttttcatatggtttaaaaatatctttttgagaataaaggcaaaatgcttcatgcataagaaaatctgtattatagcaatattgtagtaattcatctctataaggttcatcacctaaaaatgtgagcttttttccgctttcaagaatagtcgtaaatccatgttgaagttcttttgtactgtttatatcaaagaaagttgtaggtcttcctaaaatgttaacagaagtattattgcatatttcatggaaaagtattttatcatcaaatagttttagaaatttcttttgaagaacaaaagaacagatactttttaatgcttcaatagattttttatggcagtatatattaaacactccattatactttgaattgagcatcgagttagctacagatcttatgacccatacagttccaagtatatgatcattatggttatgagatataaacatattatgtatattacttattgaaatatctgctttttctaaattagaaagtattgtgtttcctccaccagcatctactaaaaaatgttcattatcattagaaatggtaaagcatgtattataacattttgtaaccatagcagagcctgtaccaagcatagttatattttccactttaaacgcctccttttgtgaaaatcatgataaatatattataaagttaataagattataagacaactgtactgttaaaaagattcatacttatgaatttagttatagaaatatggattaatattataaaaaaaataaatgtaaatgttttaaattttgtataatttaaaattatgcaaataactttacttgagaaaaatatttatatatactaatgtatatacactagtatatataaatatagctttataaattaatgcatttccaagtatattaatttaagctatgtgagtcttcgtacatagtgaatattaaaaataatatttatataaaaatcgagggggatttatataatgaataataaagttaaacaaatggtatatgcaggacttcttactgcacttgcaattattattcctattcaattttcatttttaaagatatttgtaccaccagcatttacagctactttagcagctcatgttccaatgatgctatcaatgttaatttcaccttttgtagcagttattgtaggtattgggtcaacacttggatttgccatcacagggcttccaattgtagtagtagctagagctgcaactcatataatagttggatatattggtgctaaaataattataaaaaatagaagttatgcacaagctgttcttattacagctccaattcatggtttcttagaaatgattgtagccataccttttataggattagcacttaactgggctcttattgttactttagttggaagtattatgcatcatatggttgatggtataatagcttacgcaatagtaaaggctgttgctaaatcaagaaataaagatatatatggggcttttggagagtttactacacaacaaacatgttaataataaatcaatagaaatctagaattagtttaagtatacatcttaaattgattctggattttatttgttttggaaatattaaaaataattagattatacaataataatttttaataaaaaacttaatataaatagagaaaaatttactgatttattgttaaaaataaatattaaatagaaaaaacatatagacaaatatatgaaatatcatataatgaatttagaatagttaaaataaaaatgtagaattttaatatattgtgtttagagtttaagataatagtctatgatacaaatatattttattctaataaattatgaggtgagcatagtggaagaaaaagaaataatgtcatttagagatgaagatggaaataaagtagattttgaagcaatagcaaagatttatttagaggaacaaggatatcttttattatctccagtagaagaagataatgatgatatgtttgcttttagaattgatataaatgaagaaggaaaagaagaacttaatcttgttgaagaagataatgagtttgaagcaattaaaaaagaatataaaaatttattatactaaaagatgaggtgactaaaattggatatttctgaaataaaaagctttttagaagataatgatttatctgatgttgaagaaataaagcaagaagatgactatattttgctgaaattttactatgactttgataaagatgagttaatggcggcaaaaagttattctaatgaagaaagtgattttgaagcagaaagtgatgaatggtataatgagtattatataccatttttaaaggatatagctgatgataatgttgaatctatagtagaagatgcagcagaggaatttgaaattgaagggaaatataaatctcttgtaatggaaagtggagaactaggatatcttaggtttgtagcagtattttcagcagaaatggacgaaagtgaaatggaagatattttaaacgattacgtgcagtaaaaaatggaagcttagaatattgaaaatactattgaaaatataaaaagttatgctataataaaatcatagatttcctgagatgtgcgctaaacttacgatattcaacctacattacattatcgggatttgcaatatacttaaagatgtcgggcttcatttaacttttataggtatcagaagaagacagacgtgagttgcgcttaacccacctgcgaggcgcaggttttgaatatttaagtgaacggcatgttgggaactatacttttgaaatcaacacctcagaaatgaggtgtttttttgcataaaattttatggtattattaacataaaaaaatcaatagttacttattgattaaagtttttcaataagtaactattgttttgaacatttacatctaagacatatcttctagataatatctaatgtaaatacaaatttggtaataacaacgatagaaaatagatattatcaagcaacaaacttatttcccttgttagacatattattatgtatatatattgaaaatagccttttttgatatagcacaatgtacttgtccaaatcttgtgataaaaaaaccattatttttgcagtaggatgcagaaatataagtaacatgctaagaatatgttttcttattaaaatactcattttaagtttagttaatactaaaaaattcatatattcacctctttttactataaatggataaattgtataaatatattataaacatttagggggaatttgtaaaaggtttttgtagtacaattaatgacaatatttagcaaaaatcaatcaaaaagctttaaaaagtataaaaaagaataaattaataaacacaataatacataaatggataaaaatgttaataaaatcgtttgacacgaatttccttaaaagattatttggtgtcgaattatttaatattgattatatacttcaaaataggtaaaattagtgatataagagagaaaggatgattattatggatattcaaaagatgaaaatagaggaagttgtagaaaagataaattcattatataaaactagtcaagaaagagaattaaataatgaagaaaaagaattacaagcagctcttagaaaaagatatatagataatgtaaaaagaaattttagagctcagttagatagtatagaaattaaaaaatagtaaaaaaggatgataggattgggagttaatgtaagaaaactaattgatgattttaatttagaaatcttagtacatggaaacgaagatgttgaaatatcagtaaacgatataaatagacctggtcttcaattggcaggattttataattattttgcaccagaaagaattcaagttattggaaaagctgaatggagctttttagatgacatgcagattgaattaagaaaaaaaagggttaaaaagtattttacttttgatattaattgtttgataataacaagagatttagagcctcataaagagtttttaaaagaagcagagaaacataatgtttgggtacttagaactagtcttgtaactacacagtttattagtaaaactacaatatatcttgcagataagcttgcacctgaaactagacttcatggagtattagttgacgtatcaggaataggaatactaatcacaggagaaagtggaataggtaaaagcgaaacagcattagaacttattaaaagaggtcatagacttgttacagatgatgctgtagatataagagaaattgatggtcagttaataggaacatctcctaagataacaattggtatgttagaagtaagaggtataggaataatagatgttaccactttatatggattaagttctgtagttcaacaaaaagaaataagacttgtaatgcattttgaacattggaaagatgataatgattatgatagacttggtatagatgatgaatacatgaatatattaggtattaatgtaaaaaaattaactgtgccagtaagaccaggaagaaatattgcagttataatagaagcagcagcagtaaattatagatataacttaatgtcagatattacgcctgtagacatcatagaaagcagaatgaataatataagtgacaagtaacaaactattgaaaaaggagttttttatatgagtaataataaagattttaacaaaaatgcatggactaaatatacagaaaagcaagtagaagaaatttttgatttttgtaatgggtataaggactttatgtctaaatgcaaaactgaaagagaatgtgcaactgaaataatcagccttgcaaaacaacaaggatatgaggatttagaagatataataaaaaataataaaaagttaagtgctggagataaggtttatgtaaataataaaggaaaggcagtagctttatttattgttggaagtgaaccaatggaaagtggattaaagattttaggagcacatattgattctccaagacttgatttaaagcaaaatccattatatgaagatagtgaattatcattactagatactcactattatggtggaataaaaaaataccaatgggttacacttcctttagctcttcatggagtagtagtaaagaaagatggaactatagttgatatatgtgtaggtgaggatgaaaatgatccagttgtaggtgtttcagacttacttgttcatttatcaggagaacaattaggtaaaaaagctgacaaagttgttgaaggtgaagatttaaatgtattagtaggaagcatgcctctaaaaggaactgaaaaagaagcagttaaagctaacatattaaaaatattaaaagaaaaatatgatattgaagaagatgacttcttatcagctgaaattgaagttgttccagcaggtaaagcaagagattatggattagatagaagtatgattatggcttatggtcatgatgatagagtatgttcatatacttcattgatggctatgtttgatataactgaaagtgataaaacatgctgttgtctattagtagataaagaagaaataggaagcgttggtgcaacaggtatgcattcgagattttttgaaaatgcagttgcagaaataatagataaatatgaaggatattctgatttaaaattaagaagatgtctttcaaattcaaaaatgctttcttcagatgtaagtgcggcatttgatccaaactatccaagtgtaatggaaaagaaaaattcagcattctttggaagaggaatggtatttaataaatatactggagcaagaggaaaatctggatgtaatgatgctaatgctgaatatatggctgagcttagaagtattatggaaaagcatgatgtatctttccaaacagcagaattaggaaaagtagatgctggtggaggcggaacaatagcatatattttagcacaatataatatggaagttattgattgtggagtagctcttcacaatatgcatgcaccatgggaagtagctagtaaagttgatatttacgaaactatgaagggttatagagcattcttaatagaagcataacaaaaatactaagattacctatgttatacattgtgtaatcttagtattttttaaataattacttttaataaagttaactttttaatatatttctataacttagtcgccttggcgatttttttgtttaataatattattatatagtcataggaatgtctaaagcatctaataaaggttttaaatatttttctgaaagttccatagatccaatatcaccatgtcttgtatcgttaacaatatcaccatgaaaatctgaaccacatgatgatagcatattattagtatctacaatgttaaggtaataagttgtttcatcagttgtattttgacaataaacagcttcgattccatcaaagttcatatttaaaaaatcttttatagaagattgattaattaattttggatgggctagaaaaactagtgcattatatttttttaataaatgaactccatcttcagtagataattttaaagtgggtacataagctttacagcctttacctataaaattatcaaagatataatcttgagagtaatcatagcctgcattgattattgctctggcaatatgaggccttgcaacggtatctttagaatgttttacaatatcatcgaaatttatagaaatattaaattcatctttaagtttttcgatgattttttttgctcttattattctgtgattttttatcttattaagttcatgaataagttctgaatttttaaaggaattccctttgaaaaagcctagaacatgtacactttcattattatgctgagtagataattctattcctggtattaccttgattttttggttaagaccttcagagattgcttcatcaagaccagttaatgtatcatgatctgttatggcaaggaatttaacaccgttcatcttagcacgtttaacaatatcccttggtgataaaattccatctgaagcagatgtatgaacatggaaatctactttaaccatgcaataaaaccccctaatatattttttgtatatatctagccaatagatctatgtattttttataaaatatatattatgtttttcagtttataaggtaataatttatgaatgaaagccttattgaattttaaggccatatgtaaatttataattgaaatatatatatgatataaggttttgatttaatactatttgccaaatatgaattttaataatatgataacataatattaaaaataaaagtatagaaatttatagaaatagatgaatatataataagaattgcgtaaaaaaaatactgcatagataagaatatatctaatgcagtatttttcttaatttttttgaataggtttgttttgtatgtggttacaaaaatcaagcaaattatagcgtagaggaatattttccattgaaataatatcttcttgataatttccatcccatggagaaatggcaacgattgaagagtcatatacgcgaattaaatatttaaaatcatcaaatgaaatagtgattctatatatctcttttgcatctggcttagaatcatattgaaggtaattatcagaagaaatagaagtaagaaagttatcaattattacaaattcatctttgtttacaggaatttctttatataaatttgtatcaaatactgataaagaaaacttttcgttgtttaatattttatttttaagttcatctgtatagtaatgattgtttggtttggaagtaaaatttatgtatttagaattttgagaaatacatccatttagacttaaaaccagtaatagcaataatggcagtaaaaacttcttaaacataaatcctcctatatattagttttaaccatattaatttattcatgacataatttttttagaacaataatacattatagacaataagtaatttaaaatacttataaaagtaactgtgataattattcctataaattaatattaataaacagtagtgatattttggaggatgacatgtatattataggtactgttggaccaacagttaaggataggactgtgctcaaggggataatagatggtggagcaaatgctctcaggtttaactttgctcatggtagtaatgatgaattcctagaatttttaaagactgcaagagaaataaaacctgatataagtataatgcttgatacttctggaactaaattaagaatatcaaataaatttcaatatatatataaaatctatgatggagaggaaatattcttttgcggagaagataaatatgaaataataaaaacagtaattaatcaatataggagtaaaataatacctcttaatattaaaaatgatatgttacatgaaaatgaatttagcagtatttcaataaaggataacactatgatttttgaagtgatagaaaaaaatgatgaacttataagagcaaaagcaataaaaggtggtgttattcgtaaggggaaaggatgcaatataaagggctttaataggagtatgttatcacttagtaaagaagataagaaagctataatatgggggattagaaataatgtaaatattatatgtcagtcttttgttgaaagtgcccaagatgtaaaagaggtaaaaaaatttatagaagatcataaaggtgatgaaactaatataaagatatgggcaaaggtagaaacttcaaatggcgcaaacaatataaaaaatatattaaaggaagctgatggaattgtaatagggagaggggatttgattcctgaaacttcaattgaagaaactcctatatatgaagagagaataataagagaggtatcaaagaataaggaaaaagatttaattattgggacacatatttttaatagtatgaaatctggtaaaattccacagctttctgaggttgaaagtgtttataattttattaaaaatggagttacaggttttttactggcaggagaaacatctattggtaaagctccagtaaagacagtgaaatttcttaaagacttagaacgtatatataatggaaatagttaatataagtaataaaagaaaaacataattcaaacaataatgaattatgtttttctttttataaatgtttgttaatcttatttaaaaaataagatattatcagagtcaatgcataatcatataataaaaaagcagcttgtgctattagtatcataagccaaagtgaaatctcagctttgaaacctacaaaaagattaaatattatataaataacaaacataagtacattgaatgtaatgagcttcaatattatttcataaaccatgttgtgcattttttctataaaaaattttaatattccataaattccgaaaaaaagtgtatatagtatggagatattaattggtactaaaaaaagcttaatatactacatgataaataaactagtatagtattttttaaagatgttcttatgattgatattggaattaaacatgatgcaatagttaaaatcgataaagtgcttatgggaagtaatgaagtggaatatagaacagcaagagtcagtgcaattaatattccgctttgagcaatgttatttgatttcatattgaacctcccttaaatttattagcagcagcctattaagtctccgcctgtacactcacataatgtatctaaacaccataaattaatacagcaatcgcaagcatcattgttatttgttcttgtggttctgtaatattgatttgaaaaattattgcctctttgtcttagagaatttaatgtttgtctgtattcaaagttgttaggatccatacttacagctgtatttatatggtctagagcagaatcataccagtttttattgtacataacaactccgtataagaaatgccattcagcatttctattattaatgctatttagtctttgttctgcatttgcaaaattacgattttgtatcattcttcttacgtcttgaaaatcattgaaagtattattagagtagttattactagaatttgaattccaagatgatgatgtattattgttataattatttgatttaccagaatcttttgtaagcatttcatatgctttatttatttcgataagtttatcttgagctaattcttttaatggattgtctccgtattgatctgggtgatatttttttataagttttctataggcactttttatttcatcctgacttgcaccaggatttacgcctaatatttcgtatgggttcattttataagtcactcctttttgtttcattagtatcatcaggatgattaataacttttatatatttatccatcaatccaagttcaacaatattatataagatatctttatttctatttagatttaaagtcattaaattatcttttatgctgtatccacaatttaatatggtaaattcaatacgaggtttaatagatgctataaattcttcatatatcatattatctttattatataaaaaattaattggattgaattttttatcttcaagatctttttttaaatcatcaagagcatcaattagataaatccatttacctatagaatatcctaatgtgtaaagtgtatcccgaagtgtatcagaatcatcagttagttcataaggataatttttaaaaacagtacctacaagtttgctaaatggatcacatatttcatctaatgaagaaaaagacttactattttctaatgttgaaagttcatttaaatacattttaatttcattatcaatttttaaaactgactttggaaatttttttctatatggatttaatacagaagcaaaaattttgctttttaataatttgtcatcttgaacatcatcaacaagtttatagtaaaagagagatatatttatatatgcagcgtatgatacagctttgttgttgcttataactactttcttttctgttggatgaagaatgcacctgtgagaagcgacttctacttcatcgggatttaaggcatctaaaagcaagcctaaaaaagtcatatcataattgagagacaatctaggtatgtttccaaactgcttttttatgtggcagcataaaccacaataataacatttaaacctgccaaaatcttttacttttagttctccctttaatggagtaacatatccaaacaataaaaacactcctcatataaattaagatatcataaattatatcttaattataaactattattcaatatagtttatatataagaaggtaaaatttcagataattttaacatttatttattaaagggtaaggaggaaatgaaatatttgtggagaaataaacaaagatgtcagtatttattactatatggaagagaatcaataagaaagaaaaaatttctaaaaaatttttaaaaaaggtatttacaacggataataattattatataataaaaactgtcaagaagataaaacaaaagataacaaatagttaattataaatgtgtgtaggaggaataaaattatgaaaaagtttgtttgtacagtatgtggatatgtatatgaaggtgaagcagcaccagaaaagtgcccagtatgtggagtaggaccagaaaaattcatggaacaaagtggagaaatgacatgggcatctgaacatgtaattggtgtagcacaaggtgcttcagaagatataatggcagatttaagagctaactttgaaggagaatgttgtgaagtaggaatgtacttagcaatggctagagttgctcatagagaaggttatccagaagtaggaatgtactatgaaaaggcagctttcgaagaagcagaacatgcagctaaatttgctgaattattaggagaagttgttacaaactcaactaagaagaacttagaattaagagtagaagcagaaaatggagctacagctggtaagactgacttagctaagagagctaaagcagctaacttagatgctatacatgatacagttcatgaaatggctagagatgaagctagacatggtaaagcattcaaaggattattagatagatatttcgcataattaaaaaataactttgtattgaaacaccctattcaatagatatgtatttaaagtttaataaaacccataaaaatcccttataaatttatagaagcgtatatgaatccccatttcatatacgcttcattgtttaaaaaactatatgacaataggcattcaaatgttaaaaattaatatttgaatgcctattttttatttatattatagaaaatattgtattataaagcagcattattatttacataatatttttcataagcattgttaaatgtatcaaaagttttttgatcatagcatatcattgcaatttcctcaaaagtttcaggatattcatttataaaagatgtaatctcatctaaagcaactctagtcgcattttcaaggggatatccatatgctcctgtacttatagatggaaaagctatagtcttaatagggtgttcatcaatataagtttttacatctgtaattaaattttctttctttttatttccaataaaacttggcgcactaaagcggtataggttatcattaataacctgcatactttgttcaagatatatatgagcataattagcagcaacatttaaggctgaattatacgaacgtcttaaatacttttcttcagagccattatttctaaaaataggacctacagtgtgtattatccaataaatccctaattccgtaaggttatatgactgagaaagttttgaattcccagtgagacacccatttaaatctctacattcgtctaaaagtctgcttccgcatgctttatgaatgctgccatcaacaccaccacctccaagaagagaagtattagccgcatttacaattgcatcaaactttaattttgttatatctcctaatagtatttttaattttgtcaaatcaatcacctcatacttttatcccataaattctcttacttaatagtttacacttatttttctaaaataaaaacaatttatttacattttatgtaaataaattagtctgacttttaaagatataaagatttgttggagtaataatatattctgattctttacaaataataaatatgtatctagaatgatagatgtaaaggtattattctaaatttatttttatatacaataattttaaggtaggagaaataatgtttataaagagaagaattacaatttccaatatattaatgcttataatacctgtaatacttattgctatcttagcgggtgtaataagagagccgttctttagattagtcgaagagaaaatgaattttattgaagaaaatcatcctggtgcatatataattcaagattctataaaaatagatatgaagaaattagaagataagaattttcttgagaacctgccaaaggatttagagaaaattttacaaccaaaaggatatcatcttataataagatatggtaaggaagttattttttctaatttaacagagagtgataataagtctatttcagaaattggtgaagatattttaattaaatcaaactcacttgttttagaaaagaaagaactttctttagtgaaaaatagtcttatgtacaataacaagccgctaaatattattgcagtaaattcagattatagaccattgcgcattgatataagggagcaaatgacaacttttatgattggatacataggtgtagttgttgttttggctgttataatagttactgtgactaatggaattttatcatcaaaaatttataaaaatgtaattgagccattagaacttttaagttatggagcagatcaaatcaaaaatggtaatttagattttgatatgaattatgaatatgacgatgaattcaaacaagtatgcgatgattttgatgaaatgagaataaggctaagagaaagtgtacaagctaaattaagatatgaagaaaatagaaaagagcttatggccggaatttctcatgatttaagaacacctttaacaggaataaagggatatgttgaaggattgattgatggagttgcaaatactcctgaaaaagtgaataaatatctatacactatacataggaaagcatgtgatatggatgagttagtagatagattgtttttattctcaaaattagatactgggaagtatccatttgattttgatataatatatataaatgaatatttgaaaaaaatgtatgaggatataaaagaagatttatataagagaggacttaaaatttcttatatagatcaatgttcagaaaatgttaaagctaagatagattgcagagagatacgaagagtaatatttaatatacttgataatgctgttaagtataatgaaaatgaagataaaaaaagtaaaattttaatacatgaggagaatgaatggattgttattgaaattagtgacaatggaaatggagttaatgatgaaatgctatcaaagctttttgaaagtttttatagaggagatccatctagaactaatccaagtcagggaagtggacttggactagctatctctaaaagtataattgaagctcatagaggtcaaattgaagccttaaataataatggattagtgataataataaaacttcctatatttttagattatatggagtagtatatgagtacttaagggaggatattttgtgaagaaaatattgattgtagaagatgataaaagtatagctgagttagaacaagattaccttgaaataaatggatttaaagcagaaatagctcttacgggagtcagtggattagaaaaggctattaataaagaatatgatctgattttgcttgatgtaatgcttccagggaaagatggatttgaaatatgtcaggaaataagaaaagtaaaagaaattccaatacttttggtaacagctaaaaaagatgatatttatataataagaggtcttggaattggtgcagatgattatattgtaaaaccttttagtccaagcgaacttgtggcaagagttacagcgcatatgaatagatatgagagacttacttccatggataaagaacatggaaaatcacaaaatataatatcaataggaagattaagtataaattgtgattcgagaagggtttatattggtgatactgagataaagcttgctaacaaagagtttgaattattagtatttttagcatcgaaccctaatatagtattttctaaggatacgctgctggatagaatatggggagaagagtcttttggagatacttcaactgtcacggtgcatattaatagaataagggaaaagattgaaattgatacaagtaatccacaatacattgagacagtatggggtgctggttatagatttagtctttaaataatgaaaattaccatagacatttatgtctatggtaatttttatttaaatttaacagtgtttataaattgtttatattttagttatagtgaagttagatgttacctgtaaaataaaaaaagtatttaaagataaatttagagaactacaataggagggtatagtattgaagagaaaattaatagcatttttgcttgtactttttactgcgttgagcatttcaagtacgaaagcttactgttctgatacacagacaatttctttcagcaatattaaatctattatgattgaaaatagtatagatatgaaaattgcagacaataatttaaaaaatacaaagcaggaatttcaaaaaataaatgatagtatagaagatttaggggatggtagctataaaggatctaccattagtaaaaatataagtacattggaagatgaagttgaagaattagaaagtacagttaaatctttaaaaagtcaacttgattctttgactgatagtgatccttcatattcagaggttaaaagtcaatatgaagataagaatgcgagtttaactaagaagcagtcaactttggaacaacttaagggttataaaaaaagtagaactacagcacaacgtaatttaaagaaagcagaacttacttataatcagacagttgaagatgcagtatataaagcacaacagtcatatgtaagttgtctttctactacttctcaattagaaaataaaaaaaacacattggaatataacacaaaaaaatctgaaataagtaaattacaatatgaaagtggttttttatcaaagaaagattatgaaaatactataactgataatactgatagcgaaaatgaaataaaagaacttgaaagtaaaaacgaaatagcattgaataatttaaaacttactcttggaatttctcaaggagttgatgttaatcttgataataatgtagaagctgattttaatttagtaatgtcaattaattatagtgaagatttaaaagaaatgttaaaaaacagtatagatatatcggtttcaaatctagaagttgattgggcaaaggatgatgatgacgaagacgatgatgatgacaatgattatgaaaactatactttagaaaataaagaattatcattagacaagcagtctattacttcagaaattaattttaaggaaaaatataataatcttatgacagcatataattcaataaaaagcagttatgataaattacaacagagtcaggaagattatggagtatcaagtaaaaagtattctttaggttttattacaaaaaatgaattggaaaaagcaaagcttgacttagatagcaaaatgtcagattttaattcagaaagaaatgatttttacctaaagtatctagattatactcaaatgaaggagggctattaaggtggacttaaagattaaaaatgataaggatacaaagcagaatgttaaagtaaagtctggtgttataaaatctggaattttaaaaaaagtatttaacaaaaaagttattggagtaatatgtgccatagcagttgcaggtggtggattcacagtatataaagtaaagactggagctaaaaagaatacacaatcaagtagagtaagatatacatctttaagtaaaactaatttatataagatggtaagttcatcaggagctattaagagtggaacatcaacaagtatttattctaatcttaatgattataatgttcaacagataaatgtagaagtaggggatgaagtaaaaaagggtgatgttcttgcaattatagatacatcaactttagaagatgacattgaaaagcaggaattaagtgtaagcgcaaatgaaaaaaaagctcagattgcacttgaacaagcaaaagatacatatgaaaattctgtgtatctatatgagaataatttaaatacaactcttgttaatgcacaggcagcagttgatcagaataagctatctcttgataataaaaagagtatatatgagtataagcagatgatgcttgataatggagaagagtcaagccagaatgtaaatttagccaaaatagattatgaaaatgctcagtctgattatgataaatctcagatagctttaagtgcagcaaaagtaagtgttgaacaagaaatagaaaagaataaaaagagctatgagagtgctcaagcagctgttgatgatacaagctctaggcttgcacttgaaaaacagaaagaaaaattaaaggataaagaagttgtagctactgttgatggaattgtgacagcagtaaatgcatcagttggttctaaatgtgaagactcattgtttgtaattcaagatttaaatgatcttatagtaaaagtcagtgttgatgaaacagaaattgcaaatgtagcagttggacaaaaagtacaggttactacagatgcatctactgaaattcttgacggtgaagttgtaactgttgatcctatttcaagtgctgcagcatcagaaacttcaacaagcagtagtagcagtagcagtagtaaaagtagtggaacttcatcaacaagtagtaattcaacaagtagtgatgttacttttacagttaaagtacagataacgagtgaagatattgataaagctgttaaagttgggatgaatgcagttgtaaatattattataggtgaatctgatgatgtgtttgcagtaccgtatgaatctataatagacaaccatggacaaaaatctatatatgaagcagaagagcagaatggtcaatatgtagttaaagaaatttcagttactacaggattagagtcagatatgaatacagaaatagaaggagaagatttaaaagaaggaatgattgtattaaatgatccttcaaattatcacgttggtagcgttgttgacataaacaatgggaggtaattaaatgagtgaaaatataattgaaatgaaagatataagaaaaagtttctatataggcactccaaatcagcttaatattttaaaaggtatagatattactgttaaaaaaggagagtttgtatctatagttggtcagtcaggttcaggtaaaagtacattgatgaatataattggagcacttgacagagcaacatctggctcatatgtattaagtggaaccaatattgaagatattagtgatgatggattatcagaagtaagaaataagaaaattggatttgtatttcagacatataatttaatacctagaaatacagttctaaaaaatgttgaacttccaatgctttatgcaggtgtgccaacaaaagagagaacagaaagagcaatgtattttttagaaatagtgggcatgcaggatagaattaagcatcagccaaatgaactatcaggtggtcaaaagcagagggtagcaattgcaagagcacttgctacaaatccaagtattttacttgctgatgaacctacaggagcacttgattcaggaactggaagattagtaatggatttatttcataaggttcatgaagagcaaggaaaaactattgtttttataacacataatcatgaacttgcagaagaaacagaaagaatagtaactttaagagatggaaatatagtttctgacgaatataatgacaagttctacagaagatatagtgatggtgaaaagctatgtttataaaagaaaatataatgctggctatagcagggcttaaatccaataaaatgcgtgcagttcttactatgcttggaataataataggtattggatctgtaataggtattgtttcagttggtaatgctatgacagctaatgtaacaagttcaatggctgatatgggatcgactaatgttacaattaatgtaacagaaagagatagtacatctacaaataataataaaacgaagacaaatgagaagaaaaatggaagttctactaatgaaatgccaggggctggatcccatgaaggtggtgctggaggcggaattccgggaggtggctctggtggaggaatgcccggaggtggaatgtctggtggtggaggaatgccaggaggcggaggcggaatgcctggcggaggcggaatgcctggcggaggcggaatgcctggcggaggcatgggaggtcatagtggccgctttggcagttcaagtacttctacaccaaaggactcagatcttttaacaatgagtcagataaaagaattagaggaaaactttggtgatgagatagatgcttttagtgttacagcaacaaaagatactggaaaagctaaaagtggaacagcatatgctaatgtaaacattactggtacaaatccaggatatgaaaaagtaaagaacatagaaatggcatatggaaggtatattacagatacagatgttgacggctcaaaaatggttgcagtagtttcagataaattggtaagtaaaatctttggtgagggtgcagatccaattggacaggaagtgaaaatatatacttcaagtgcaattcattgttatacaatagttggtgtatacacttataaatcgtctggaggaagtacggaatcagaggaaaagcttacaacagatttatatattcctgtaacagcagcaaaaagctcatcatcaaataaaaattatcagacagttaccataagagctaaagataatgttgatattacaacatttactacagaacttcaaacgtatctagataagctatatattaaaaatactaagtataaagcaactgcaagtaatatggaaagtatgcttgaatcaatgacttctatgacatcaacaatggctcttgcaatatcggcaatagcagctatttcccttcttgttggtggtattggagtaatgaatataatgcttgtatctgttactgaaagaacaagggaaataggtacaagaaaagcattaggagcaaaaagttctcatataaagatgcagtttatagttgaatcaatgataatatgtgcaattggaggcattattggaatagttcttggaataattataggagtcataggtgctcatgttatggggaattcaccagttatatcacctatggttatagtaggaagttttacattttctatggttattggaatattctttggatattatccagctaaaaaggcagcaggtttagatcctatagaagcattaaggtatgaataaaatttaattaggatattatcataaggtccttgaacataaaaacaagggccttatttttataaaaaattaaaaataaatagtttaattgatactaaaaaacagactatacaatttaaatataaagatttctatattcaattggtgtaattccttcaacctctttgaatacttttgaaaaattacattgatcacaaaaacttaaattggtggagatttctaagatgcttttatttgtactttttaatagagttttcgctctatttatttttataattttaaagtatttcattattgatatgcccatattatttttaaaacacttacacatatagccaactgacatgtttaattctttagatatttcttctaaagtgaagttttcttctaaatgaatatacaaaaaagctaatattttattggttataaaattatttgtcacttctactgaatttacaagtatatctaaataagtatctgccatatccaactctactttttgcatatctgatagggtcgtcagagtctgtattgttttataatatttattatatagggtgtgaagaaactgttttgttgaaccattttttatgatttctcttatgtagataacattccaaataagtaagtcagttcttttggtagaaagaggtagaaatgcttcttgtaattcatctttatgtttttttaaaataatagaaattattgcatctttatttttttgttgaaataaaaatgaaaattcattattaaaaaaatagtcatcagaatcatatgaatcatacatagatatatttcctttctttattatcacttttattaacatacaaaatcaataattatcacttttttaattaatcatgtataaaaattccaactatatatgtaaacattatacaacatatatgaaaaaatggttaattttaaataaaaaatgttaataataaacaaatttgataagtatgggttgatataataattttgtaagggttgcaaccgtttaccgataaattatagaatttattaaatttttaagtggaaggtgagatacgtgagtaagaagtttaaagctatgtcattaattattgcaggacttatgggagtaacacttttaagtggatgtggaagtattggtgggaatagttcaaatggaaatagtgatgatgaaataattgtatggtcatatttaatggataatgaagttgaggaagttaataaaatagcacaagaatggggaaaagaaaataatagaaaagttacagtagttaaagataactctgattttcaaaattttctccaggcagcaaattcatcaaaaggacctgatgttgtatttggaatagcacataataatttaggtacattccatgaagcagggcttcttgaagaaattcctgatggttttgtaaataaagatggatatgtaaattcaactgtatgggatgctgtttcttatgataataaaccttttgcagttccaatatctatggaaacatatgcattattttataataaagataaggtaaaacaaatgccagaaaatattgaaaaattagtggaagaggcaaaagcatatggtccttcaggatttcaattttctatgaatgaattttattatacagcagcatttgttcaaagttatggtggatatgtatttggaaataagaatggcacaacagatataaatgatattggacttggtaatgaaggttcaataaaagcatataaatttctacaagacttagttcaaaaagataaattaatgccagcagacataactactgatattgcaaatagtaattttaaaacgggcaatgctatttattatattggtggtccatgggatgtgagtggatttaaagatgcaggagtaaactttggtgtagcaccaatacctaagattaataattctgatgctaaaacatttatgggagttcaatcagcatttgtaagtagtaattcaaataaaaaagatgattcatggaatcttcttaaatatcttgttgaaaattcacctgaaaaattatatgaagttggaaacagacttcctgttattaaatctaaattagaagtggatgaaataaaaaataatgaatatagtcaagcattcataaaacaagcccagagttcagttcctatgcctaatgttccagagatagaatgcatatgggaaccattaaaaaatatcacaagaatattcaatggtgaagatgtagcaactgtagctaaagatatagaacagggagtaaaagacggaattgaaatgtctaaataattaaaatttacaataagtaaggtgattagatatgagaaagagaaaaagtaatcttgaaagctataagtacctttcaccagcattgataagcatattaatattgagtgtattgcctacattatacactatttttatggcatttactgattacacacttaaaaatcaaaactttggttacggaacagaaaaaggatggcattttgtaggattgtatcaatttaaacagattttgactggacctcttaaaagtcagtttcttccactttttggatggactttaatttttactgtgatttcaacagtaggagcatattttattggattgatatttgcaatggctttagatgataagaacatgaaagaatcatttatatacaaagccttacttgtaataccatgggcccttccaggtgcaattacaataatttccttcaaaggtttatttaatagtgagtatggagcaatcaatacattattgcttcaaataaatttaattaaagaacctgtattgtggcttacaactccaatggcatcaaggatagcagttataatagtcaatctatggctagggtatccttatatgatgaatgtatgtattggagctttatcttcaatacctgacacatattatgaagctgcagatattgacggtgcttcaagatggcagaagttcaaaaatataacacttccgtcaataagtaatgtgtcatatcccttattgatttcaaactttgcatttaattttaataattttaatgctgcataccttttaacagaaggtggtccatcaaaatctggttcttcatttgcagggtggacagatattattggatctgcaacttataaaatgtcaactagtaagggcaactttgcacttggtgcagcaatgtcaatacttatattcataataataggtgtaatatcatttgcaaatatgagagcttcaggtcaatttaaggaggcagagaatggttaaggagaattcagtaagtactattaaaactaaaaagggaattggattaagtaagagagcaaaaattgagctaaatataaaaagagtatttttgatattttctatattacttttgatgtttccggtgtttgctattataacagcttcattatcaactggtacaagctttatgcagaaaaacttaatacctgaaagtataacgtttaataattatattaaggcattttcagatgaagtaggttttagtaaatggatgttaaatactacatttgtagcagttacagttgcactttttcaactttttttgacgataccatcagcatttgctttttcaaaactaaaatttaaaggaaaaagcaaatggctaatgtttttaataatacttcaaatgtttccatcgtctatgacagtaccagcaatactttcaattgcttataaggtaccatttggaatggataatctattatttttagctcttattttatgtgctggaagcgcttataatatatggcttatgaaaggatttattgatggaatcccaaatgaccttgaagaagcagcaagaatagatggggcaacaacatggcaggtctttacaaagataatattacctcttgcaaaatcaatggctgttgtaatttttttctttgcatttattgcagtatatagcgaatttgtattttcagcagcacttataaaaaataaagatttacttactgtggttgttggtatgaagtcttttactgcaggaaaattaactgactggccaatgtattcagcatgctcaatattgatttctgttcctcttgcaattgtatttgtatcaattcagagatttatatcaaaaggacttgttgcaggtgcagtaaaagaatagaaaaatatattttttagaaagttattataaaatggaggattaaaagtgaataaatacgcagtatatcacataacagatgcaccgtattcttatcctaaagatttgaatactttatctgtaataataagaacagcaaaagatgatataaaatcctgtaggatatattataaaacaagatatgattggcaaaatccatttaatataaaagaaatgaaaaaaagtgatacaaataaattatttgattattataaagcagatatatcagttgaacgtaataggtatagatattattttgaacttgaagataataatggagaagtagaatttttcgatgaacgtggatttaaaaagcaaatggaaaaaaggccagaagcagctagttttcaatatccatacattgcagagagtgatgcatatgagaaagtgaattggcttcaagaagctgttgtataccaaatttttgttgagcgattttgtgatggagataaaagtatagatcctgaagaagcattagagtgggggagtgatgtaacgaccaattctaagtttggtggagatttacaagggattatagataaattagattatttagaagatcttggagtgaatttaatttatttaacgcctatatttaaatcgtcatcaaatcataagtataatacatgtgactactataagattgaaccacagtttggaacgctggataaggctaaggaacttgttttaaagtgtcatgaaagaaatataaagatagtttttgatgcagtatttaaccattcaggatcagatttctttgcatttaaagatattttgaaaaatcagcaaaaatcaaagtatactaattggtatttcatagataactatcctgtcgatattaataagtgtaactattatacatttgcagattatataagtacaatgcctaaatttaatacttcaaatgaagatgtaaaagaatatttattgaatgttggagcgtattggattaacgaagttgggattgatggatggcgtttagatgtatgtgatgaagtagatcactgtttttggagagattttaagaaaaaaataaaacatagtaaaaaggatgccattttgataggtgaaataatgcatgaatcaagttcatttttgaagggagaccagttagacagtataatgaattatccttttaagggagctatgatagattttttcggtaatagaagtataaatgcagaagagtttgatgatattcttgcaaaaaatagagtgatttatatggatgatataaacagacagctttggaatttgattggaagtcatgatacatcaaggtttttgacagagtgtgaagaaaaaatagagcgaatgaaattagctatagtatttcaatttacttatattggtgtaccgtatatatattatggtgatgaaattggacttgcaggaggagaagaaccacaatcgagaaagtgtatgatatgggattcgaaagaacagaattgtgaacttttagaattttataaaaagatgataaaaataagaaaagaaaataaagttctgatttatggagattataaaactgtttattgtaaggataatataattgcttttattagggaagataaagataataaagtactagttataataaataatacttataaaaaagtgaaaataaatagtaataaagatcatgaatatatgaatatgattacaggaaaatttgaattaattaaagatactattgagattgattcaatgagttataaaattttgaaattatatagaaatatatcattaaatgggactgcttaagtaaattatttagagttataaagatatcttatatatggaattaaaaaagattcatatatgagatatttttatttataatacttggcataactagttaagggtatattttttctataggagaacaatatattattgtaaggtttataaataatcttgaaaggaagagttttaggtgcttagaaataaaaaaatatttctcctagatattgatggtactgtatctgttggaaataatgtaatagaaggtacctttgaatttttagactatattgttggtaatggtggaaaatatatttttataacgaataattctagtaaaagtatagatgactatgtagaaaaatttaatgggttgggatttaaagttgatgagagcaattttataactgcatcttatgctacagcattatatttgaagaataattataataataataaaatatttgtattaggtacaaaatcatttattgaggagcttaaaaagttcaatttaaatattacagaaaaattagaagaaaaaataagttgtgtagttgtagcttacgatgatgaattgacatataaaaaaatcgaaaaaatatgtgaacttctttcaaaagagaaaagtgtagattatatagcaacaaatcctgatttagtatgtccagtatcttttgggtttgttccagattgtgggtcactatgcatgatgattgaaaatgcaaccaagagaaagccagaatacataggaaagcctaatagatttataatagatatatgtcttgataaatataattgcaaaaatgaagatatgattattattggagataggttatacactgatattctatgtgggataaatacagatattgatacctgcttggttttaactggagaagcagtagaggatgatttaaaagagtctaaaattcagcctaaatatgtctttaatagtattaaagaactttatgaaggcttaaaataaataacatatatgttaaaattctaaagctacataataaattatagaaatattttcagtagagattttaaatttaattgcttacagggagtatctaagaagatactctataataaaatgtaaatcgcaatatatgttaaaagatttatgaaggtagggataacattacatatataagttacttaatttatactatatagtaattggatatttctgaaaaaggaaattgaaaaaagatatatcatatgatatattaagtgtataatattaattaatttaaaacatataattaatatgtttatagaatgttttaaatgcttttatataaaagctaaataaattttagaaatggggtataaatatgatattagtaaattgtgcattaagacaagacgacataattaaaattgtagagggacttgaagtagatgggacaaatcctttcaaattcaaaagtaagcaaggacttcaaatgttttttgaatcaacttacggtgatgatgaaaaagcagcttcatttgtaaagtcacaaataaaatcaacagaagttggtaaagcattattcttcagtgttgctgtaaaataagaattttaaaatttgaaattttaaaaaaaataaattgcaactaattttcaaaagttaacaattaaaataaacaatgagcttgtacataaaggttatttgtgtacaagctcattgtttattttctttttttacaattttaatttgatgtagaatattaaaagttatgtagaatttatacaataagtgtataaatatatactttctatttattatacttataaaaacttaaaaaaagtaataaaaatatagtataaaaagtcatataatttcaaatttatatatatataaagtaaaataagtatgatataatctaaataatgttgtttaaaatttacgcaatattaaatataaattattgcaagatagaattttttttatttcaaaaaagaatatattctgccagtaatttatattaataaaaactttaattaaaggagttgtatttaaattggggaaaaaatttaaaagagtcttagttgccaacagaggcgagattgctataagaatttttagagcttgtcatgaactgggtataagaactgtggctatatattcggaggaggataaatgctctctttttagaactaaggctcatgaagcatatttaatcggaagaaataaaggtccagttgaagcgtatttaaacatggatgaaattatagaccttgcaataaagaagcatgtagatgctattcatccaggttatggatttttatcagaaaatgctgaatttgcaagaagatgtgaagaagcaggaattgaatttataggtccaaaatcagaaatgatggaaaagctaggcgataaaatacaatctaaaatcgttgcagagggtgttggtgttccagtaataccaggtttagataagccagttgaaactgaagcagaagctttagaagcagctaaatactgtggatatccagtaatggttaaagcagcagcaggcggcggcggaagaggtatgagaattgtaagacgcgaagaagagcttgtagaaaattatagaaatgctaaaaatgaagctaaaaaagcttttggtatagatgatatatttatagaaaagtacatagaaagaccaaaacatattgaaattcaagttttaggagataaatacggtaatgtagttcatctttatgaaagagactgctcaattcaaagaagacatcaaaaggttatagaatttactccagcaattactctaagtgatgaaaaaagacaggaaatctgtaacgatgcattaaagattgcaaaatcagtagattatagaagtgcaggtactttagaatttttagttgatgcaaatggaaatcactattttatagaaatgaatccaagagttcaagttgaacatactataacagaaatgacaactggagtagatatagttcaaagtcagattttaattgcagaaggatatgaattaagttctaaggaagtaggaataccttcacaagaagctataaaaccaagaggatatgctatccaatgtagaataacaacagaagatccggcaaataattttgctccagacacaggaagaattgatgtatacagaagtggagcaggttttggtatcagacatgatggtggtaatggatttgcaggtgcagtaataagtccttattatgatagtttacttgtaaagactactgcatattcaagaacttttgaagatacaataagaaaatcaatacgttcaataaaggaattaacaataacaggcgttaaaactaatgttgatttcgtaataaatgttttaaataatgaacaatttagagagggtacatgtgatactaactttattgcagataacccacaattgtttgatatatcaccaagaacagatgaagagcatagagtgttaaagtttattggtgaaagaatagtaaatgttacaaaaggaaataaaaaggaatttgatgttcctgttattccacatgtaagtggagaaattgttaaaactcttagtggtactaaacagatattagatgaaaaaggccctcaaggagttgttgattatattaagaatcaaaacaaacttttacttacagatacaacaatgagagatgctcaacagtcgttacttgctacaagagtaagaagtgttgacatgagcaagattgcaaaatcaactgcttattatggtcaggatttattttctcttgaaatgtggggaggagctacatttgatacagcatatagatttttaaaagaatctccttggcaaagacttgagtcattaagaaagagaatcccaaatgtaatgttccaaatgcttgtaagaggtgctaatggtgtaggatataaaaactaccctgataatgtaataagatcatttataaaagaagcagcagatactggaatagatatattcagaatttttgattcacttaactggcttaaaggaatagaagtatcattggatgaagtattaaaggcaaataaggttgcagaagttgcactttgttatactggagatattttagatgaaactagagataaatattcccttcaatattatgttgataaagctaaagaaattgaaaaaatgggagctcatatcttagcaattaaggatatgtcagcacttcttaaaccatatgcagctaaaaaacttattactgcattaaaaaatgaagtatctcttccaatacatcttcatacacatgatactacaggtaatggtgtagcaactgtacttatggcagcagatgctggagttgatattgtagatacaacatttaacagtatgtcaggacttacaagtcagcctgcacttaactctattgttgctgcacttggaaatactaatagagatacgaaaatagatattgctggaattcagaaaatatctgagtattgggaagctgtaagaccagtatatagtgaatatgaatcagatttaaaatcaggaagcactgaaatttacaaatacgaaattccaggtggtcagtattcaaacttaaaaccacaagctgaaagttttggccttgggcatagatttgatgaaattaaaaagatgtatggcgtagttaatgatatgcttggagatattataaaggttacaccttcttcaaaaatggttggagatatggcaatctttatggtacaaaatgatttaacaccagaaaacatatatgaaaaagctgctaatatggcattcccagattcagtagtatcatactttaaaggaatgatgggtcagcctgaaggtggattccctgaaaaattacaaaaacttgtacttaagggtgaagaagctataacagtaagaccaggagaattattacctcctgaagattttgataaaatagctgcttatttagaagaaaaatataaatttaaaccatcgaataaggatttaataagttatgctttatatccagatgtatttgaagatttcataaaacatgttatggaatatggtgaagtaagacttatgggaagtgatgtattcttccatggcctttcagaaggtgaaacaagtgaaattgaagttaaggaaggtaaaatccttattgttcagttaattgaaattggaagacttgatgctcaaggtttcagagctcttgaatttgaaattaacggaaacagaagatctataaagattaaagataagactgaaagagctcaagcaaatcttggtgatggaaacacaactgtaatggcagatacagataataagatggaagttggagcaagtatacctggtaatgtaataaaagttcttgtccaagaaggtcaagaagttaaagaaggtgaaagtcttatagtagttgaagctatgaagatggaaacaaatgttgtagcttcagtagatggtactgttgaaaaaatatttgctaaagaaggtcaacaagttaagactggtgaattacttgttaaattaaaataatataaatatatattaattacttataataaggcattttgaatattcttcaaaatgccttatttaatttgtactcacaaaaatgtgaaatttaaataatatagtaaggtaaaagctattaatttaaggagaaaaatatgtatttgtcaaaaccggcagagggattttgtatacctgttttatatataagaaaagagcatctagatataagtgaacttaaggatattgcaagtaaagaggttgaaaaaactattttttcaagaggagaaactttaaatgacgatgattgtttaaagaaatctaatgaagatgaaaaaataagtgaaagattaatatttgatgatgatgatattaatattgaagaagtaaaagaaactatcgttaagagaaaagttgaagaagtcgatgttaaaaatgttggttttcttatttttgatggagatattaaggatgagggagaagactctgactatatattaaaggataaaaacaagaaaaaacaaataggataaaaaacatataaggatagtaaataagctaaaaagtattatactttttagcttatttatttggagtttattagaattaaaaaaatttataattaataattttataaagaaaataaatatagaatttttgcaatatttattgcattttaacagttacaggaatataattatattaaagaaaaggtttacagaaaattataattattaagaaatttgtaattgactactttttatgctagttattgaaaattaaatttaattttactctaagttactttttattaaattttagggggaatttatatgttgggattttcagaactttgtatctatttagtaaaatgtgtgtacagatttttaaagtatacaggcttaatagtaccagtatcagtagcagcattaataataagtgttcaagaaggctatttgggattttcactatctaattcaaatatagctatatatttagatttcttattgttatatttttcatctatagtttttttatatatttttattaagcatttaagaaaaacttttaatgaattaaagttggatgtgaaatatattaaagaacatgtcaatgaaaagcatgtgtcttgataaaaatataagttaaaaagtgataaggttaatttgaaaaaattaaattagatatagtagaaacagtactgagcaaaatatgtttgatgatgcttagtactgttttttgtgcaaaataaagcagcttatataaggggaaataagctgctttaaaatatttaaatagggataaataatgaaaagttttgaataattatcttatgctattgattatatagattaattgttacaatagtatgtcaatttatcagaatatatattttttaattaagtttatttatatggaaaatgaattaggtaattttattcaatatttgcaagattttgagctgaaattaacaagaaatagagaaaccataattgtataataaaaaatataagataattaaccagctttattttcgaatctgatgcatcaaagaagtttttgaattttataatttagcgatggtagtatcatatcttatttcttagattaagaagattaaaattgaacataaatttagaaataaataactatatagagttttaaaaataataaaaatcaaaaaggtaggtaggaagtatggatgtaattactattggagatgcaatggttgcaatgtgtcctaaggagaaaggaccaatattattctgtaatacttttgaaagaaaaatagggggagcagaattaaatgtagcaattggatgtgcaagacttggtttaaaatcaggatggataagtagacttggacaagatgattttggaaaacatattcttaaaacagtgaggggagaaggcatagatacatctcaaattgaattagtagaaggatatcagacatctgtttattttagataagttatggcaaatggtgacagtagatcattttactatagagaaaactctccaacaagtactatgacagcagagtcgttagatgaaaattactttagaaattcaaaagttctacatataacaggagtttttccatcaatcaatgataataataaagaaatattattgaaagcagtagaactagctaaaaaaaataatttattaatatcttttgatcctaatataaggttgaaaatgtggacaaagagtcaagcaagagaatttattaataaatttttaagtgaggtagatattcttttagttggagatgaagaaatatcaatattgattgatgaagaagacacaaatgaagcgataaaaaaatttcatgatatgggaatcgacaaagttgttgttaagagaggcgcaaaaggtgctataggttcagatggttcgaatatttatgatgtagcagcaattaagcctaaagccttaattgatacagttggtgcaggcgatggatttgcagcaggattcttaagtgcatatttaaaaggagactcttttgaggaaagtatagaatttgctaatgctgttggatccttagtagttggaattgagggagataatgagggactaccttattatgaagacgttttagcacatttaggaaaaataaagacaattgaaagatagaaataagaagaggtgtagatatatgtttgaaaatacttataagatattaaaagaagaaaaagctgttgctgtaataaggacaagtacttatgaagaagcaaaggaaattagtatagcagcaattgagggtggaataaaaattatagaagttacaatgagtgttccagatgcaccaaagttaataaaagaattaaaagataaatataatgatgtatgtgtaggtgctggaactgtattatcaaaagataatgtagatgagtgtatagaaaatggaacagactttattgtatctccatgtttagatgaagaagttataggatatgctaatcaaagaaaagttttagttattccaggtcttatgacaatgtcagaattaaacagggcttataaaatgggattaagatttattaaagtattcccaggaagtgtagttggaaaaggatttataggagcagcaaaatcaatatttaatgacatatgcataatgccaacaggaggagtaaaaaaggaaaatatagttgaatggattaatgctggtgcagattgtagtgggattggcagtgatttaaataaaatatataaaactgatggtgcttatggagttaaagaatattgtaggcttgttaaagaagaagtaaagaaaacagaaaaataaaagtaaattttagatttaattggattatacaagcttatgagagagttttcagtataaaataattaggaatttaatcatggatacagtaaatttaattaaataaatttactgtatctttctttataagaaattatcttatataaatacatataagataaaaaatcagaatgtgctttttgtgaatacatattatgtccaagcagtgtgtattgaaattattgaataatttgtaaaaatatcaaataaagatagtaaatatgatataatatacacagattttgtacaagcttagattgtataagaaaattgatttatcttatagatttagataaatcttattaagctatatttatatacaatatttaaggaggcaaaaatggcacatactgaagaaaagaataagaagattacaagtagtaatgttgattatacttctaaaattgagagagctaaggaaccctttaagaatgagatattaaaaatgcagacaaaagaagagaaacttttgtatttaaagcaacagaaacaaagatatgttttattaaaagaaaatagtaataatgcatatctaatatcaatggttgtgagttttgttcttgtaataagtcttataatactgcttgcaaaaacagaaaaaagtgtgttttttataagttttatgtttgcattaataatagtcatgggaatagtatggatagtgttgtttatgacaatgaaaaatacaagtacaaattatactataattctatttgcacttgatgatttgaaagaaaagattcaaggcagccttggtggaggttatgatgatgtaaccaaacttaaggaaataataataggaattaattctgaaattgaggacactaaacagcaagttaaagaaggatattcaataattgagcaaagaataaaagagttttctaaaaagtaatagaatctttaaaatatgtgatgcaggtatttatataaataggcatcacatattttttgttttaatattgtttacctattattgaatcagtagaaacttttatatattcacaataagaacaatcaatatcattaaaatatgataaatatctttttttgaatttaagtaaaattgaattttgctcattagtatcattaatgatttcagaagttccacaagctgttatcaattgatatgcatctatatagaatcctaatatggaattttcgatggatatatagattttttctagattgtttatattatgaattattttatccttattaatatttataaagtaaaatgtaaaattgtcattatcataatcaaagacatataacattggaacaatatttagagtatctgaactagttataaaattacagattttttttgactctagtgcggatatgatttcatttgtatgaagagttcgatatttacgaatatccataaaaataattcctcattttatattattcttatatataatatgaaataattctaaaaaagttgtgaattttatttaagtaaaagtgccttaaatattcattacgtaagtattatttgtagtataaatacattattaaaaataattaataaagcaaaatagtttttattaaaaaatgcttgaaaagcatgctgaaaaatagtacataggtattagcaatattgtaaaaattaaattatcatataagtattaatgattaagagaaatattaagtaagatattgacaaaataacatttgaaaagagagtgatttattgtgatagataataaaaagaaaagtcaggcccctgcacctgcaacacaattttttggaacagaggcttttgagtcttcaaaccagacaacaatacgttggcttggaaattcaggagaatttattaattgtcatggaacgtgcataatgatagacccattattaaagggatttgacctgccattacttattgatataccaattttgcccaaggatgttcctcacttagatgctgttttaattactcattgtgataatgatcactatagtagagtgacatgtagtgaaatgaaagatgtatgtgatgaatatcattccactgaatatgtagcagaattaatgaaagaagaaggtcttaaagcttttgggcataaaataaaggaaacttttgaaattggtcctgttaaagttacattaacaccagctgaccatgcatggcaaaatgaatcatcaaaacatgctactcgtttatttaaatttgaagattactgtggattttggttagaaacacctgatggaacaatttggatgcctggagattcacgattattacaagaacatctggaaatgccagtaccagatgttatacttatggatttttctgatagcaaatggcatataggtttagatggtgctgtaaagttagcagaagcatatcctaatactccattattgcttttacattggggaacagtagatgctccgcatatggcagaatttaatggggatccaaaggagcttgaaaaacttataataaatccagaacgaattaatgtagtggcaccaggtgaaccatttatattaaaacacttaaataaaacaaatattggttaaattaaatgataattgatgaactatcggaaagaaatataatagaggaattttaattcagaaaatagagagtaattttaataaaagcagagaattcatagtttaagagaatctctgtttttattttattaaaaattcttagaggtaatatttagattaagttagctgatgttatcaatgcttaaaaagcatatcttatagcaagttatgttgaaagggacttttttatatgctatgatttatatattgaagggagtgtagatatggaacttagagtattaaagtattttttaatggtggctagagaagaaaacattacaaaagcagcaaatcttttgcatgtcacacaacctacattatcaagacaattaatgcagcttgaagaagagcttggagtaaaactttttaatagaagtaaacatagtataatattgactgaagatggaatgttattaaagcgtcgggctcaagaaatagttacgttagctaataaaacagaacaggaattttcacataaagaaggtaatttgactggtgaaattgcaataggatgtgctgaaactaagaatatgtcttttatatcagaacaaatggtttactttcgtaaagataatcctcttatacaatatagtatttatagtggaatagcagatgatattaaagatagaattgagaagggaatattagatattggattattaacagaaccagtggatataggtaaatatgaatttattcgcatgcctaaaaaagagcagtggggcatattagtgagaaaagattctatattggcttctaaaaaatgtatatatccaaaagatttagttgatatccctttaataatggccaaaagagaaatggtaaaaaatgagttggcaagctggtttggagattattatgattctcttgatatagcagcaacatacaatcttattttaaatgcgactattatggtggaaaataaggtaggtgcagctctgtgctttaattttgaaaatgtatatgataatctatgttttatacctctttatcctaagctggaaactggtactgttcttgtatggaagaagaatcaaactttttcaaaagcgacagatcaatttataaagcgtattagaaatgctctttaggcatttgaaatgatttattataggtattagacattacataatgtgtatattagaatgtaggtgttcagatagaacatctacatttttgcgttatgaaatattaacaagaaaggagaaggattaatatgtatttgattagtaaaatttaagctattaattttaatcaatgaaatgctttttaagcatgatagacaatagattataagtattagatattagaaatatatggtgttaacattaagttagaattatttataatatagagaaattgaggtacaagtatgttttcgaatgaatcacttaagaaattaattattccaatatttatggatcagattttaattattatagcatctataattgcaactatgatgatttcatatgcaggggaagcagctgtatcagcagtttctcttattgatatgataaatatgcttcttataaatgtattagcagcacttactgctggtggagctgtaattgtatcacaatatataggatctaaagacaaagataaagcttgcaacgctgctagtcaattatttaccatagcaacaattatttcaattggaattatgggttttgtatttacatttcataaaccactattaaaaattctttttggcaatgtagatcataatgttatgaatttagcaattacttattttgttatatattctatatcctatccttttttatcaatttatgattctggtgctgcattattcagagctattggaaattcacgagttcctatgatagtttcaattgcaatgaatgcaattaacattgtgggaaatgcaataggaatttttgttttcaatgcaggtgttgtcggcattgctatatcaataataatttcacgtgcatttgcggctttagttatggtgtatttatcattaaataaaaagaataaagtatttattagcttttcagaaatatttactattaagcgagatatgattattaaaattttaaatatagcaattccaaatggaatagaaaatggtattgtccagttaggaagaatactattgattagtatcattgcattatttggtactaatcaaattgctgcaaatggaataacaaacagtcttgttatgatatcaattagttttgcaacagctatgaatatagcaatagttagtgtaatagggcaatgtgttggagctggtgattatgcacaagcagatttttatacaaagaaattattaaaaataacgtatataggaactatagttataagtttagcagaaattttacttcttccatggatattaaatttgtacacattatcagcggaagtgactaatttaacttatatattagttataattcataattgcctggcgataattttttggccactatcatttacattgcctaatagtttacgtgcttctggggatgtacgttttactatgattgtatctattagttctatgtttatactcagaatatcttttggatatattttggggattatatttaatttaggagtaattggtgtgtggcttgctatgggggcagattgggcgttacgttctataatttatgtgttgcgttttaaaaatggaaaatggagagagtttaaggttatataaatttttaagaaaggatgattaaagatggacagaattaaatctagtgaaaaaatacaaaagcaattatggggagacaaaaatagtgaattaatgacaagtgactcagaactctatgaaataatgaaaagatttatatatggtgaggtatggcaacatggaaatttagagcctaagattcgtgagttaattataattgcagttaatattacaaataataatatggaacaatgtgcagaacatgttgaagcagcattgaatattggtatatcaccagtagagataaaagaaactttataccaatgtgctccttatgtgggattttcaaaagttcaaaatgcaattgttgttacaaatcaaatatttgaagaaaaaggtgttaaacttccacttgaaaatcaatcaacaacaacagaaaataatagaattgctaaaggtattgaagtacaaaaatcgatctttggctcaaaaaatattgataatcttagagcaaatgcaccagataatctaaaacatattcaagattatttatctggttactgttttggggatatttgcggaagaaatggtcttgatataaagattagagagcttataaccttcattattatagcaacacttggaggttgtgaaaatcaacttcgtgcacatattgggggcaatgcagcaataggaaatgataaagaaactttattaaatgtaataacacaatgtatgccatacattggatttccaagaactctaaatgctatcacatgtataaatgaagtgttaaagtaagtttcattaactactaaatttttaacagaaaaaataatttataatggaaccattattgttgcaaaaaaattttatagaagtaccaaacatacaaaaaaaggctgtaatacaaggcatttaaaccttgtattacagccattcttataaataaatggtgccgctagccggattcgaaccggcacggtatcactaccagaggattttgagtccaccacgtctgccagttccatcatagcggcatgttactgacaaaaaatattctagcatgaatagataaaaaattcaacagttattttaaaaataaatttacaataatataataaattacatttgattacagttgtaacttatgatggaatattttctatgtagtaaaataaggagtacattatttgagagtatataaaggaaaatggtattttattgatatttttttaatgaaaaagtttagtttttatcattttactatagaaaaaataaaaaaatgaatatttagagaataaattttcaaataaaggttgttccaagtgaaatcatttgctagaatagtagtaggggaaacgccccgctgggtcaatttgtgcccagagcaattttgaaaacttagaaataaggtttaatagttgtgattatctattaattagggaggagcaaaaatatatgatgtattcaaaagaagttgaagaaatgtgtgtacttgctaaaggtcctaatcacgggccagcaccaattcctgcagaaggaaaatgggttcaatctaaagaagtaactgatatatcaggattaactcatggtataggttggtgtgcaccacaacaaggagcttgtaaattaacacttaatgttaaggacggtataatcgaagaagcattagttgaaacaattggatgttcaggaatgactcattcagctgctatggcttcagaaatattaccaggaaagactatattagaagcattaaacacagacttagtttgtgatgctataaacactgcaatgagagaattattcttacaaatcgtttacggaagaactcaaactgcattctctgaaggcggattaccaatcggagcaggtcttgaagacttaggtaagggattaagatcacaagttggtactatgtacggaactttagctaaaggacctagatacttagaaatggctgaaggatatgttacagaagtagctgtagacgaagataaagaaatcatcggatacaagttcgttaacttaggaaaaatgatggaaagtatcgctaaaggtgttgacgctaatgaagctttagaagctgctagaggacaatacggaagagttgacgatgctgctcaattattagacccaagacataactaattatttgtgaaggaggaattttaaaatggcattatttgaaagttatgaaagaagaatagaccaaatcactccagtattagaaaaatacggaatgaaaactttagaagatgcaaaggcagtttgtgctgaaaaaggagtagatccttacacaatcgctaaagaaactcaaccaatcgcgttcgaaaacgctggatgggcttacactttaggtgctgctatagctataaagaaaggttgcgtaaaggctgctgatgctgctgaagcaatcggagaaggattacaagcattctgtatcccaggatcagttgctgatgacagaaaagttggtttaggacacggaaacttaggagctatgcttttaagagaagaaactaaatgtttcgcattcttagcaggacacgaatcattcgctgctgctgaaggtgctatcaaaatagctgaaaaagctaacagagtaagaaaagaaccattaagagttatcttaaacggtcttggaaaagatgctgcatacatcatttcaagaatcaacggattcacttacgttcaaactcaatttgactactacactggtgaagtaaaagtagttaaagaaaaagcatactcaaacggagaaagagctaaagtaagatgttacggttcagacgacgttagagaaggtgttgcaatcatgcatatggaaggtgttgacgtatcaatcactggtaactcaacaaacccaacaagattccaacatccagttgctggaacatataagaaagaatgtatcgaacaaggtaagaaatacttctcagtagcatcaggtggtggtacaggaagaactcttcacccagataacatggctgcaggtccagcttcttacggaatgactgatactatgggaagaatgcactcagatgcacaattcgctggttcatcatcagttcctgctcacgttgaaatgatgggtcttatcggaatgggtaacaacccaatggtaggagctactgttgctgttgcagtttctgttgaagaagctatgagcaaatagtaataccaacattttatagatttatattaattttaaattattataaattaagtgttttaaaacataaaaaatagtaatttgtcaacgtattgagttgatagatgaaaaaagagtaactttttagttactcttttttcatatttctaaaattttttatataatttcatctgtaacatgagtatacatatctaattttatatatgatttttatgttatagtctttcttgaattacttttatatttacatccaaatttaaaagtatcctagtgtgagtatggattagacatgatacgctcgtttttaatattctataaagattgccataataaatttatagagaattaatatttgtgttgattaatatactcgtaaagaaaataattgaataatagcttgcaattatatattaatagtggtatacttataaatattaaaaagattatttaattttacacttctccttaattagagaattatattattaatatctttaagaataaggaggaatttaatatgacagataagacattagtatgtaaagattgtggaagtgaatttgttttcacagttggagaacaagaattctacaaagaaaaaggttttgaaaatgaacctgttagatgtgcagcttgtagaagagcaagaaaagaacaaaataatagaagataatagaagataatagaagaacgttagagttgtgagattttatcgcaactctttttttattgccataaaaaatgtaaaaaaggtgaatgaaatgtatttaaaaatctaatattttatgtagtatatataaaatatagggttcattagtagtttatccctaaaagctactttccaattattagaactaagttttagaacaaaataaaccagtacaagtgttaaaaaacatctgtgtgctggtttattcatttgtcatggaaaacaatatgaaagaaaagtgcatttcttttggaagaataacagaaaaatttgataaaactaatagttatgcgtcaagatagtgtgtaataagaaataaatactgttaaatatgcactgttctttttattgtgtggttaattacttttttatttattaggaacattatttaagacgtattgtgtttagttgataactcttatcagttcctgtgcttttataatactataaaaaaatactaaagtcaacattaatgataattattttcaattaaatatataaatacttttgctaatttgaatctgaatttatattttgaaatttaaagatagatttcttgaattttaataaacatgtgagagaatttctgattctatttcatattgttaaaaattatcatatatattataaaataaaaaataaaagtgttttattttataaaattataaaaaatatgaagtttaatttaaaaattataattaataagatataattgttataaaaaagtgaaaagcgaggggaaaaatgaaaaaagtagtagaatttaagaaaatattattcggactaatattaatattagttcttataccggttatattattaacaatatcatcaggtgttataaatagaaataatgctaataagaattataaagaaaatgcagatttattacttaaaattgcagggggaacaattgataataaaattggggaatactatagtattatacaattattatctagtgatggagatttttatgattttgataaattaaaaaaatctatggatttattagaaaaaagagatgaaagtatacttaatatttattatgcatctgaatccgatggatcttacgttcagtcattagatcatgaacttccagagggatacaatgctaaatcaaggccatggtttataaattctatggcagatcagagcaactttatagtagaaagtccatattctgatcctacaacaggaaatattgttcttactatttctaaagctgttactaaagataattctgcaataggtgttgtttctatggatattgaattgacaaagcttgcagatatattatctgaatataaatatggtgaaacaggacaacttatgatatgtacagatgaaggtgtagtaatttctaatactgatgaaagtaaaataggtggacaagaaccattagagtatgatgtatgggataatattataagtaatgatagtggtgaagttgattttgaatatagttcaaatgggtatttaggatattattcaactacaaaaaccactggatggaagattatcttaaagactgaaataaatgaaatacgagcttctgagagatatcaattgatgttatctatattaattatgttaattatattagttttaattactattataattaatattggtacaaaaatggtatctaacaatataaaaaagttagttgaaagtattacgaaagcatctaagggtgattttaaagaaaaaataaatcttaataccataataaaagaatttaaacttttagaagaaagttttaataatatgtcaggaaatttaactaatttacttggcagcgtaaatgattctgtaataaatgtagataacacaactgtaaactcaattgcattaagtgaagaaatatctgagtctataggacaggtaacaaacactatgactgaaatttcagaaggtacagggaaatcagcagatggtcttgaaaatattgcatctgatatggaaagattatcatcttctattaatgaaataaaaaatgaaactaataatgtgaataaagttgcttttgaaacaaataaattaggaggaagaggtttagaaattgctaaattagtattaaataaatcaaatgaaactaaaaacagtacagaagaagtaaattctgttgttaatgaagtatcaagcagtattgaaaagattgaaaatattaatagtagtataacagcaataactgaacagacaaatcttttggcattaaatgccgcaatagaagctgcaagagctggtgaagcaggaaaaggatttgctgttgtagctgatgaaataagaaaacttgcagaagaaacagcagtttcagcaaaagaaatagattcaattataaaagagataagtgaaaaatctaataaggctgtagataaagtatcaaatactactaatgtagtaaaagagcaggaagaagctgttatggaatctcaaaaaatattcaaagatatagtgcattctgttgaaagcttaagtgataaagtatcaattatagcagatagtatttccataataaatactatgaaagataatgtattagataaagttggagatctctcagctttattagaggaaacagcagcaggaagtgaggaagtgacagcatctgctcatgaagttaatgcatcaaccgagacatttgtacatgatttgaatatattgaaggaaaaaacagaagagttaaaacaacatatttcaacttttaatttttagttcattaatataaaaatcacacaatttatacatagaaagagttcaagaaaagacaatattacttagtcttttcttgaactcttttatttatagaaaaattaatatccgatttgctcatttattaaaattacttccatttcttttattccattcattttctttattaatacagaaacaccacaacatattctatcaggactagagcagtcataacatttcatttctttacttacagcacaaggtgtttttaatccaagtcgctttgcgttgagaggagcagcaatatttctagcacgccataatgctttttcaaaagtttcctcgactttatttatgccaactattatatatactttttcatgaccatacataattgatgagattctgttaccacttccatcaatatttattatttcacctgtttcagctattgcattagcagaagaaatatagatttgtgctgtttgagaattagacctagcttcttgttgtggttgtctccaatgccaataaacttcattatttattgataaggtttcaaataaatttaactcttctaatgttttactaccaccaaaccctattgtttttttatttagctgtgaatcaagatattttactgcactatcattattttcaaagaatgaaacagtaaagccttccctttttaaattatctaataattttgatatattcatattataagcccccttagtattaatttttataaaagaatcatatttaatttgagaataagtaattataattggttaacttttaaatttatatacaattataccatatagtaattatgaggtttttaatgagaaatattttgtggatattataattaataatgtgaaattagaaaagtaagtattatttttttcaaatagctaataataaaatatattattgtacaaatattgaaatgataaaaaattaatatatatgttgttagctttatggaggaaaaatgaaagttttaaaaagattattattacttatgagtatatttgtactgagcactatgttttttatatatcaaacaacaaatgttagaattttaagcttagaaagaaatccagcaaaagtctctgtatttttatcagatttcaatgacgatttgatctcagaaataagaaaaaatctagaggagattgaaaagaaaaatgatgataaagtagaatataatttttatgatgggaagttaaatcagaaaaatcaaaatgatgaaattgcaaaggtattagaagaaggaactgatttaatattattaaatatagtagatagagcatattctaaaactgttatagataaaataaaagcaaataatgttccagtgattttatttaatagagagcctcttacctctgtgccaatacaatcatatggaagagccatatatattggaactgatccagtgcaggcaggtattttacagggggagatgttaatagatttatggaattcaagtaagaaaattatagatagaaataatgatgaaatactacaatattatatgctagaaggtgaaggtgataatacagaagcaacagaaagaactaaatatgttatttctacaattgagaaatcggggataaaaacccagcaagtaggggttgactttgctgattggtctgagaaagatgcatataaatatacaaaagaagtctttggaaaatatagctcagatatagatgttataattgcaaatgatgatagtatggcaataggtgctgttaaggcattacaagaatatggctataataaaggtgaaaaatcaaaaacaattccagttgtaggcgttgatgtgattccaaaagctaaagaatttattgaaaaaggatatatgttaggctcagtatatcaagatcctaaagattatgcagaagctttatatgaagttggaatgaatttaattaattataagaatcctgtagctgatacaaaatatacacttgatgatacaaaagtatcaattcgtattccacatactaattatttttataataatatatttgctaaataatacaaatttatatattaaaaataaagaaatactgaattttatcaatgtttctttattttttatattattctaaactatatatttataatttaaatttaatagtgtccaatcacattactctttcatattatgtaacaaatacagaaaggaagtaaagtgaatggcgcttaatattcaaggtgtagatataagtaataataatactatatcaaatttgtctactcttacagaaaatggagttcagtacttatatttaaaaagtactgaaggagctacttttgtagatcaaacaacaccagctagatacgtacaagctaagaatttaggattaaaagtgggattttatcattttttagtaggaacaagtttaccagaagcacaggcagaaaatgcatataatgctacaaaaacttatgctcaagatcttgcatttatgttagacgttgaagttaattttgattctctttgtgattatgttttaagatttataaacagatggcaggaactttcaaatgttgaaataggcatctatacctatagtggttttataagtaacttaacagcaatatcaaattatatagagagtagaaaactatggatagcaaattatacttcttcatataataatgtaaatacaggattttttataatattgtaggatggcagtatactgaaaatggaactataggaagtttttctggagattgtgattactttagtcaaaattgtttggtacagtctaaacaaggtgaatggcagttaaataatgttggttggtggtataaatttaatgatggaacttatccagcaaatgaatggtataaaatagatggaaaatggtatttgtttaatagtgaaggatatatgctttatggatggcagtggtcagatggtggtaactggtattacctaggaagcagaaatgatggatctatgaaaacaggttgggtgttgactggtggaaagtggtactattttaattctcaaggtgctatgcaagttggatggcaggagataaacaaccaatggtattattttgattcaaatggagaaatgcagacaggctggttgaagtataatggagaatattatttattgtatagtgatggtcagatggcacgtaattgtgaattatatggatatagctttaataatagtggagttgcaacaaaaattcaataagattatataatagaaacaagaacagaaaaaataaggttctaaaaattaaaatgtgcttttgacgaatttacaaagtataatgctaagtttttagtatagaatgctttatattggttttgtcaagcacaatttttaatatttaagtaaaaataactttgaatttttttattaaataatactatatatcacataatttgtttatgaataaaaatatatatagatatggagtattttatttagtttagaatttagttcagaagcaagggggattctgtttggatgataacattatccgagattacaaagaagcggttcatgaaatatccaaagcatattattttataaataatgatgagtctgatgcagtatatggacaggacgtttataataaatcaataaagcaatatccatatttttttattgcaggagcaggtataagttcagagtcagtaaagacatctgcacagattacagcagaatgtaaaaggatatgtaaagaaaatcaatacaatagaagtagaaatgtggaagaacagtattcatactggcttgaaaaagcatttccacataaagaaacaagaaaaaggtatatcaaaaatcttattaaggataaaagaatacctgaaagtgcaataaaacttgccaatatacttttatctagaaaagtaagcaatttagttgttactcctaattttgatacatttatatatgacacattaaagctttttggtgaaaataatattataatatctgatacttgtaagagtgcagggaagctcaatattgaaagcaacagcttaaacatattacatgtatatggaacatatgaattttacgattgcgttagtcagaagtattcaaatgaaagaaataaggatttagatgaattgttttcagtacgttcttttttaagaactgctctaaatggtatgtctccacttgttataggttatagtggatgggaaaatgatgttataatgagtgaattaaaagaaagatttaaaatgccattaaagtataaaatgtattggttctgccataatgaagaggactacaagaatcttccgttatggatcaaatattcagatgaagaaaaaaaatagtacgagatgacgttatttttgtgcttccaaaagaggaaagggtttatggatttgaaattgatgatgatttaaaatactctgattttaatgatgttctagattcaggagaggtattaagcagttttataagtgaatttaatataaaatctccagatataattcaaaatccaatacaatttcttaaaaaatactttgaagaaaattttgcaaaaaatatttattctgattttcttcttttaagatttaatgaaagtggaaatgataaagaaattcaggcaataaaggaagctataataagtaaggatatagttgaaatcataaataaaacagaaaattttgcaaataatttagatgatcatggagaggaaaatgtaaggattcttctaaactatcttgttacaacaatagaacaacacacagttgcaggactagagagaggcaacctaaaaaaagtaattaatttatataaaaaattatataaatacatggaaaaatcatcagtagataaagacaagcttgacttaattaaagttagactagaagaaattttgactttagataattataatgttattaaaggtgaaattgacagtatattaaatattatgaacaccataagtgaaagcagtgaaggatataaggatgtatatagaaaatgtataaatattaaattatctcatagtgaagaagatagtgatgatttatataacagtataatagataagattcaaaaatgggatgaacctgaagatagaaaattattaataaaaatgtatatggaaaaagccatatttcttgaagaagatgatgatatggaaggttcaatagctatgcttgaaaatgcagaaaaatattttccgtatgtaaaagatgatgaatggcttgaaaatgtatttattttatgcagattaaggaaagcagaattgtataatgatttagaagaatatgataaggcactgacagaaattgatgcagttaagaatagatattatgatagagaagatctgaaattgaagcaatttcttgctgacactatgattttaaagggatctatacttaaaaaaaatatgaggcttgaagaagcagaagaatcttttgatgagatatacagtaaatacagtatggacaaagatgaaaatataagaagaaaggctgttaaagctcttataaataaagcagaagtacttgaaatggatgaggatttctatgaagcaatagaagtttataatgatataataaatagatataaagatgataatgatgatgaactgcgaagggcagcagcacaggcaagattaaataaacttgtaattttgactaaaaatgaaaaggatgaggttatagttagaaaatgtaatgagattttaaatatatacaaagatgaaaatgatgaaaagataaaattagtttgtcttcaagtaactttgtgcaaagctataggacttcataatagtggaaagcaaaaagaagcaatggaactttataacgatataattaaagctagaaaagaagatgcagatataaaaatgaaatctcttataatggaagctagaatatttaaatcatattgtttaaaggataatacagaaacactagataccaaggaaatgtgtaatgaaataataactttatgtaaatctgatgaggggaaaaaggctaagacaaaagtagttgagacaatgcttaatcaggctgattctcttattaaatctggagatgttgatgaaggtataaaaatatataatgaaatagaaataacatataaagataatgctaaaataataggaacaatacgtgaatttattcaaagcatagcaaaatacagttttgatagtgcaaaacttatttatgaacagcttaaatataattgtataaattcttcttatgaagttgaagatgaagtattgctagctggattcagcatacttataaataataaagatgctgactttaatcttatagaagataatgctataggcttaagcagaagaaatgataatattaagaaagaaattgaagccattgtaggaaatattggtacagatgcatatatgaataaaaatttcaatatggcagaaaagtattactatcttttatataggttaaataataacatgtgtcttaatattgcatatatgataagaaggaaggaagttaaaaatgttaatatatatccagattgtgaagctttgatagaaagtgcagctgtaaaaggcagtgatatggcaaatataaataaagcactcttgttagctgataaagaaatgtatgatgatgctgttgcatgcataagaaaaataaataatacagcttcttttgaatggtggaagcatatggatgatgggagagcgagaaatataaagtactatttatgggacttattacaggaaggataagtgaaagtgaattaagtattaatgatgtaatagaaaaactagaaggtttccacgaaaatgattttattcttcatatagaaagggtaatttatcttgaaaaataattataatattaaagtaaaatatatatttaaatatgaagaaatataagacttagcctaatgtaatttgataatgttacattgggcttttgtactaatcaataaaaattttgagatttggataaatatagtatatactaataattgtttgtaagatgcaattggaaaaaagcaatgatgtggatcaggtgttaaataacaggaggaaaagtatgaaatctgtaaatgctcttaaagtagcaaaggaacatggattatatttaaaattagtaacagctgtaagaaattttgattcatataatagtttttataatatttatgatgaatttgaagagccttgcagaaggattgcaataataacgaaaaatgagactatagaagaagtttatgataatgaaaataataaagatttttttgaaagcaaaataatagaaggaaacctttggatagaggaatattctcttcttacaaatcctgaaaaaatagatttatcacaattagaggtaccagaaactcttattaaaaatttcttggatgagatttaaaaattagtattagttttttagaaaaaataaattgttaaaaatatatactactagtaaaaaatatgtgaaacaagcatataatgtattgaggaaaagcataaataagcaattaaagttttgactgtatgcttgaataattttaaagaagggaattatattatgataattaacagtcttaatccttctatttgcagtacagttatgttttgtggtatagggctagtagtattacgattactttttattggaggagccatattagattgcttaaaagataataaatagtaaaactaatgaatgaattgatttatagtgaagaataaaaatgaacagaacaaaaataggctgaatatttacttataatagtatatagaaattatgctaatatactaaaagtaaattattcagtctttatattttgtataaaatagattttaatattgtcaataagaattcatttatataatattcattttggatttttctataaaatgaatattgttatttattaaatagagaagtttactgatataatacatttagagttttaaattgtcctgataaatattaaacgtaataacagaggtatgatgaaaatgacaaaaaaattaaaaatagtaatgccagattattttaaacaatttaaatgtataggaggaaagtgtgaagatagctgttgtattggttgggatatagatgttgatgaaaaaacatttagacaatatatgaagctagataacgaagaattcaatactattttagcaaagaatatgcaaaaaaatcatgagtgtagtaatgaatttattgattatggaaaagttcagcttaataaagaaaaaagatgtccatttctaaatgaatgtaattactgtattatacattctaaacttggagaagattatctttctaatacatgtagccattttccaagagtattgaacaaagtagatgaagattatgaaatatcacttgatgtatcatgccctgaagctgctaggattgttcttggaaatagaagtggatttaaatttgaaaaagatgacattcaattaaagaaatatataatagctggagagattgatacaaatgacgaagaatatgaggatcatccaataaaatattttaaagaaataagagagttttgtataagaattattaaaaatagaaagtttgatttgagtgaaaggttatatatacttggtgattttttatatgaagtagaagagaaaggctgtgatgatagtgaaatgatttgtggatttataaaaacttataatatacatgatgtagctaaaaattatagaaaaaataaagataattacataatgcagatttctcttttaaataatataataaattctttagaaatatatgaggaaacagacagtgaattgtttaaaaaatatactaaagaaactatagatggatttaatatagagagtccagaacagttagagaaagacagcaatagatatattaatacttttatagagtatagtaggaattacattgaagaaaatgagcatattttcgagaattatttagttaattttatgtataataatttatttccgtattcagagagtgattctatgtttgaagggtatatgatgcttattatgagatattcattaataagattttatcttgtaggaaaatatcttattaataacactgagtcatctgaagagataattaaatttatccaggtcttttctaagaccgttgagcacgataaaaattatatggaagaaatattagattttttaatagaaaataattttgataatttagaatttacacaaatgcttatataaaataaataatatgattaaaaataaaaaaacatattgaaatgtataagaataaggaatataataaatattatgtaaaaaaatggtgatgaaatgttgagagaattttcgaggaaatttgttaattatttggcggaaaataattataatgaagaagaaatagaacaaatggaatatgtatttagatcaactatgtttgagatactaaaggtgttaggagaggttttgatttttgctgcactagggtattttaaagaaatcgtaattgtattactagtaatgcttacaactaaaccatacattggaggatatcatgaagatactcaaatgaaatgttttatgtgttcacttttgatttcgggtggaataatattattaagtagtcagtgtaatttcacatttataggaaatattattatattaatattttgtatatttgccatttataatcaagctcccataattaatccgtctatgcccttaacgagaaatgaattaataaataagaatagggtgagggggttaactgcatctatattttggagtttaacatcaatagcaataagttattattcatcttattttttaataattacattaactatttttgttaatagtgtattaatgtttaataaaaaagagacatctaatgaataagaattaaaatatatcatttaacacacaaaacttataagtaatgaaacttgtcttatatattgagataggtttcattattttttataaaatatattacttttattaagtttgatatataatgataaaatgtaataaattttacttagaaaaatttaggataaaggatgaagaaaaaatggataattttaattttgaaaatttaaatggtgaagaaatctgggaaaaactttataataaagagctaaatacaaagaaaaacatattagagtacatagaaatgacaggaatacttataaaagaaaaagttgatatatatcaaattgaatcaacatacaattttatatataaaaaaatagatgaaatgggtgcaattattaagcctaatacggtaatgtttttgcaaaataaattaaaggaaaagctaggaaaatatgtttcgttgaaggatcctaaaatgcaaagtacatttattgaattttttaaagaagcatatccaaagggtgaaagaagaaaagattttacatgggtacttttagatataaataatatttcggatgaacagatatggactacattaaaatatataaatagagaatgtttaaatgaagacttgttcttagatgatgaagaaatagaagacatagtaaaggttataggtaagcttgttagaaataacaatattaaatatataaatgatattagaagtttaagtactctaaatagtatccttaaaataaaagtaatagaggataaaggtaagtttaaagtaaaaagattagaaaaataaacttaaatattgataaacctctttaataagtatttttatttattattaaagaggtttatatattactaactacacagtttttttgatttttttacaattactccattaaatttatttagatatatggagatataatagttgttatctataagtttagcacgtttcttttttgatattttattttttccaccaaatttttcagaatcagtattaataatttcatcataccatcctgaagaatcaacttggagaaggaaagaagagcactctgaatcacctaaattaagaactgtgtaagaacaatcttcttcaagatcatttctcttatatgcaaagatacatggcatgttatcatcagtttgaatccaattgaaactatttttattatattcatttttataaaggctagattctttagaatatatttcttggagttttgaaaaataatttttaaataacatatgtttagggtaatctagaatatcccagtctatttctttattgcaatgccatgtttcaaactgtccaatttcatttcccataaagttaagtttttttccaggatgagtcatcataaaaagataaaaacatttaagattactgaatttttcatcataatcaccatacataagattaacaacagaatttttaaaatgtgaaacttcatcatgagatactggtaagagatatagttcattataaaaatattcaattgaaaattttaatttgtgtctgttagagcttctgtcataaggatttaactgaaaatattcaagtgaatcatgcatccatccaaagttccatttatagtcaaatccaacgccaccataaactacaggggcagttatcttggagaagacagaagaatcttctgcaataagcattacatttggatgtctattttgaagtgcaaaattactgcttctaagaaaccataaacctgcttcgttaactcctttgtttaaatccccactttcatatatcataatagatacagcatcgtatcttaaaccatccatatgataataagacaaccagaaatcaagtgaagatcgtacaaagcttattacatatggtttcgtaaagtcaaaaaggttagtatcccattcactgcttctattttcatcagaattgctttcataaatataacttccatcatacttgctaagagaaaatgaatcttttacaaaatgagcaggtacaacatcaagtattacacctatattttcattatggcatttattaatgaatttcattaaatctttaggattaccatatctacttgtagcactaaaatatccacttacttgatatccccacgatccatcaaatggatgttcagtaataggaagaagttcaatatgagtgtatcccatttcctttacataagggataataatatctgcaatttcattataattatagaaatcatattcgttatctttaattttccatgaagaaagatgaacttcataaatatttagtggagagttaaaattttttgttcttgaattcatccataaatcatctgtccattgaaagtcgtttatattatatactattgatgctgtatcaggtcttaattcactaaaaaatgcaaatggatctattttatctataatttcattttctttagtgaaaatgcgatatttatatagtgacatttcaggtacatctttaacaaaaatactccatactccagaaggatggagttccatatcgtatcctgaccaatcattaaatgttccaacaagcaaaactctttcagcattaggtgcgtatacagtaaatcttactccatgctgttggtattcatacgaaaaatgagctccaaaagtattatatgcatcaagagaattaccctgaagaatattattaatttcattattattaatcataaatgttacctcaatataccatattttatatatataattttaacaatttaaaatatataaaccaattgtttttagcttttttattgtaaagtctaaatattataattggaatttatataaaatcataaaaattcagaaaattaagaaaatgtgttgcaaacatttacaaaaggttgtataatgtaatcaagataagaagtgatttatcttagtgaactgacacttaaatccggcagagaatcatatccataaaggtatgatgttggtgccaggcaacaaaaaaacctgggagcaaagcatgacataagggcatgcacatgttggcggacaacttaaaaatcagtttctaagaaggagctatcattttaacagagtttatttgttaaaggatggctcttttcgatgtataaaaaattatatattagagaaaaaatagtaaagtataaaagatgagcttcatataatacaatataggaaaatttaagattaaattaatatttttctatgcattattaataaggggataatattatgatagcttcaggattgggttcttcaataaacatgctatttgttaccttgattgtgagcgggatattacttttattattacttttattttattatatttcattggctgtagattcatgggaagtcaggaatggtggcaatgaagagaagaaaacagatttaattaattcagatgttagtgaagaaggcattaaggagatagaagaagaaaaaattatagaaggtaaaaataaagaataagcaatatgaaaaggtttactagaatgaaaggatttaagcagtgagagagatatgtagtttttctcactgttatttttaagtaaagtttaatagttaagataaactaggattgatttgatgttaaatagtaaacttgaaataagcataaagaatctatatactagacattataaataaatcggaaactggagataggtgaatgaaaaaattcaagaaaatttatatagaaataactaatgtgtgcaatttaagttgtaatttttgtcctaaaacttctagaaaatatgaatttatgaataaagattcttttgaagaaataataaaaaaattaaaggtcatacagatcatgtatattttcatttgatgggggaaccctttttaaataaaaatttagaacattttttagatattagtggagaaaataatcttaaagttaacataacaactaatggaacattgataaaggatgttaaaaatattcttattcaatccaagagcttaagacaaataaatatttctcttcatagttttgaggctaatgataatgaaacaaattttcaggaatatatacaaaatataataaactttatcaaggaaacatcagaaaaaacagagataatatgttctttaaggttatggaatttagatggtaaatataaagcaagtaatgatatgaatatagatatatttaaattatttgaagaggaatttaatttagatacaaaactcaatgaagtttttaaagaaaaacacagttttaaattaaaagacagagtgtatataagtatgggagaaaagtttaaatggccatctctcaaagatgaagaacttggcgagagagccttttgttatggattaagagatcaaataggcattcttgttgatggaactgtagttccttgctgtcttgatagtgaaggaagtataccattaggaaacatattcacacaagatttagaaagtatagtaaattcagaaagagctgttgctatatataatggattttcaggaagaaaagctgttgaagatttatgtaaaaaatgtggatttataaatagagtaagatagatgataacttaaaataaatgtatgaataaatttcatcttaaattagaatactaataatataattggtattatttaaggaggaaaatttatggaattaagggacagtaaaacaaaaataaatttattaagagcatttgcaggtgaaagtcaagctagaaatagatacgatattgcagcagaaaaagcaaaaaaagagggacttcacattatagaaagtttatttaagtatacagctaaccaggaaaaggctcatgcagaagcgtttttaggaaaacttaaagattttgcgggaagtaatatagacattgataatgctacttatccaattgaaggtgatgatccaactttaaagcttcttatgtcagcagcacataatgaacatgaagagcatgatgttgtttataaagaatttgcacaagttgctcaatcagaaggctttcaagatatagcagtactttttaataatatagcttctattgaaaaggttcatgcagaacgttttgaacgctatgctaaagaacttgaaaacggaagtttatttaaaaaagagatagatgtaaaatggatgtgtactaattgcggctttatatacgaaggaaaagaagctcctaaatattgtccggtttgttcaaagcctcaaagttatgctattttatttgaaaattcattctttgaataataaatatagaaaagtttaaaatttaataatttaaaaatatttttgtataacaatgtataaagcaatagaaaacagtcaataatccctaaataaggagggattattgatgataatgaataaaaaaagaatgtttgttgtaatgacagtactattagcaattatattttcgttaacgtattatttttgtgataaatatataacaaaaccaattgtagaaaaagaaaatgcaacagttgtaaataatgattcaagtaacgatctttcagatgaaactaaagtatgtctttattctggtgacgttaaggaagatgagctatcacttggtgatttaaaaaaacagttaaacataggtgatgatttaacagaaacagaattatcaaaagcattgaaagataaaggatatgtattggttttaacatctgaaaaagaacttacttttaaaagagatccttctcagactgtaaaacctaacaaatattatattggtgaaaaagatggatatcttgcaatatataagactgatgaaaatggtactttattaatcgaaaatagtgacgatgtatataatgacagaaaaactatagatagtcttacaccagctgatataacaaaaataaaaaattttaaatatgaatatgatactaaagaggaagcagaagaaaatctatcagaatttttatcatagaattaacttaagcagtattcagagtgttttaataactttgatactgcttttttatgtttaaagaaatgtgttaagatttataattaaatagaagatttacagcaactcattttaagattaagttgaaagattattatgaaaatgataaagtataatttaggcttatacatagggagatggaggatacgacaatatgtatgaatacataaaaggaaaatatatgggaatgaataaagactatatagtagttgaaaatagtggaataggatataaaattttcacatcaggagcgacgatgtcctcagtgcctgagtgtggtgaagaagtgatattatatgttgatcagatagttagagaagactttattggtctatatggttttgattcaaaggaagaacttgctatgtttaaacttcttcttactgttaatggtgttggacctaaagcagctttatcgttattatcaataagcagattaaataatttgaaatatgctataatgactggtgatgagaaacacatatgcagaggtgttggaatagggaaaaaaactgcagcaagaattattttggaattaaaagataaacttcaaccagatgaattattagatgtggctgttgattcaaataaagataataatggagaaaataatcttatggccgtttcggaagttttaagtgcgcttattgcattaggatatagtgaaaaagaatcagaaaaagtacttaaaacaatagataaaacagaaactgtagaaaacatgattaaaaatgcattaaaagcgcttatgaattaattaatacagttgaaagtttatagtaaaaaagttgattatgaaattcctagggggatttctaaagtttatattgtaataatattattatttaaaatgtaaggttttaataagtttaaaataactgttaactggaaaagtggggtgtaacatggaacgaatagtaaatccatctgaattaaatagtgattttaactcggaattaagtttaagacctcaaaaaataaatgagtatatcggacaagagaaagttaaagaaagacttgatatattcattaaagcagctaaaaatagaaatgaggcacttgaccatgtgttgctgtatggaccaccaggactaggaaaaactacacttgctaatattattgccaaggaaatgaccggtgatctaaaagtaacttcaggacctgcaatagaaagagctggagatctagctgcaatattaactacacttaaggattatgatgttttatttattgatgaaattcacagacttaatagaagtgtagaagaaatattatatccagctatggaagattatgtactggatatagtaataggaaaaggtgctagtgctaaatctatacgaatagatcttcctaaatttactcttattggtgccacaacaagagttggtatgcttacagcaccgttaagagatagatttggagttctttgtgccatggaatattatacaaatgatgaacttaaagaaataatagtgagaagtgcatcggtatttggatgctctattacagaagaaggtgcaatagaaattgcaagaagatcaagaggaactccaagaattgcaaacaggcttttaaaaagagttagagattattcagaagtaaaatctaataagattatatctttaaaagaagcgagagaagcactacaattattagaagtagataatctaggatttgacagggttgataataaaatattggaagcaattatagataattttaagggcggtcctgtaggaattgaaacattatcatattttataggagaagaacttggaacaattgaagatgtttatgaaccatatcttcttcagcaaggatttataataagaactccaagaggaagaattgcaagtgataaagcttatgaacatcttggaagagttaatccatcaaagaaaagggaacctaaaattcagggaacattttttgataaagaaaattaagtgtataattaatttaaatttaaaatagatatttgatattttgtgcattttatggatgtttacttagagtgtaaagttaataataaaatttaaaatattctgtaagaatgtcatctataactgtcaattgtcaattataaggttgggagataataaaatgaacgttaaagattttgatttttatttaccagaagagttgatagcacaacatcctttagaaaaaagggatacatcaagacttatggtattagataaaaaaactggagaaatagagcataaggtttttcatgatatagtagactacttaaatgcaggggatactttagttttaaataatactagagtaatgcctgcaaggttaataggagaaaaagaagaaacaggtggaaaaattgaattccttttacttaagagagttgaaaaggatagatgggaatgtcttgcaaagccaggtaaatcagcaagggtaggaagaaaattcacttttggtgaaggaaagcttaaggcagaagttgttgaagttaaagaaaatggaaatagaatagtggaatttcattatgagggtatttttgaagaagtacttgattcgttaggcgaaatgccacttcctccatatatacatgaaagattagaagatagagaaagatatcagactgtatattcaaaagaaaatggttcggcagcagctccaacagcaggattacattttacaaatcaattaatagaacaaataaaagaaaaaggtataaatgttgtttatcttactttacatgttggtcttggtacatttagaccagtaaaggttgaaaatcttgaagaacatgaaatgcactcagaattttatatgctttcaaaagaaagtgcagatataataaatgaaacaaaaagaaatggtggaagagttatttctgttggaactacatcaacaagaaccttggaaactattggtgatgaaaatggattcgtaaaggaacaaagtggatggactaatatatttatttatccaggatataagtttaaagtggtagataatttaataacaaatttccatttaccagaatcaactttaataatgttagtttcaactcttgcaggaaaagaacatgttatgaatgcatataaaacagcagttgaagaaaaatatagatttttctcatttggagatgcaatgttcataaaataattgacaagaatgaatttatcaataacaattaaatagaaagtctttttagattttttaaatataaatctgatattcagatggaatatcaactgtaattgtcaggaaaaataattctgacagttgaacaattgatgaggtgacatagtcaagtgtttgtagttatatataaaattataattaagaggtgacgcttgtgagtaaaagatacacgttgttaaaaaaggatggaaaagcaagaagaggtcagtttgttactcctcatggaacaatacagactcctgtgtttatgaatgttggaacattagcagcaattaaaggtgcagtttcaagtatggatttaaaggatattggatgtcaagttgaattatctaatacatatcacttacatttaagaccaactgatacagttgttaataaaatgggtggattacataagtttatgaattgggatagaccaatattaacagattcaggtggattccaagtattttcattatcagcaatgagaaagattaaggaagaaggagtttactttaattctcacattgatggtaaaaagatatttatgggaccagaagaatcaatgcagattcaaagtaatttagcatctacaatagcaatggcttttgatgaatgtataccaaatccttcaacaagagaatacgttgaaagatctgtagcaagaactacaagatggcttgaaagatgtaaaattgaaatggatagattaaattctaaagatgatacaataaataaagaacaaatgctttttggtataaaccaaggtggagtttatgaagatataagaatagcacatgctaaggaaatcacaaagatggatttagatggatatgctataggtggtttagctgttggtgaaagccatgaagatatgtacagaataatagacgctgttgtaccacatcttccagaagataaaccaatatatttaatgggtgttggaactccagaaaatatattagaagcagttgatagaggtgttgatttctttgactgtgttcttccagcgagaaatggtagacatggaaatgtttatacaagcgaaggaaaactaaatttaatgaatgctaaatttgagcttgatgagaagcctattgatgaaacttgtcaatgtcctgcatgtaaacactacacaagatcttatataagacatttatttaaggctaaagaaatgcttgctatgagactttgcgtgttacataacttatacttctataataagttaatggaagagataagaactgctatagatggcggatattataaagaatttaaggaaaagaagctacaggaatggaaagttaagtagttaaataaaatccctttaggatttgatagataatcctaaagggattgtttgtttttatagctagattttaattataaatatgtaaaattaaaattataagatattacaagaataaaatgatatttttgggagaatatattaatatatgaaacataatatgaataaatcattaaatttgtaataacagggttgatattattatgtaataaaggtaaactacttaacatggaatagttataaaatattataaagttggaggaaaaatataatgaatggtactatgggagcaattcttattaatgtattaccttttgtagttgttttagcagtgttttatttcttaatgatagttcctgaaaagaagagaaagaaaacatatcaaacaatgatagaagaattaagagttcatgatgaaatagttacaagaggtggaatagttggtaaaataactaatatcgaagaaaaatatgtaactattgaaacaagtaatgcaaagacaaaaataaagttcgataagagcggtattgcatataaaacaagtaaagaatcataagtataaacaataacgattaataaaactttataaattaatttttgtaattatatatgaagttttgtttatatttaatataaagcagatttatataataaatattaatcataatgccttcttgtacctcataaaatgaagtattaggaggtgttgctttatggaaaataataattattttaaatgtgttttgaaaggaactgtaggtacccttttgtttactttttcaggaattgtagtattatcttttttaatgactaaattagtgtttagtaaacatatgtttaacgttttatatttagttatttctttaataagtcttgcatttggtgctatgatagctgcaaagaaaaaacagtcaaaaggtctgcttgttggttttggcgttacagtattttactctgtaatcatatacattgtctgccttataatgaatggaggatttagttttaatatgtttgaactatttaaacttgttgctgcacttattgttggaggacttggaggagtacttggcgttaatatgcaggaatagagtaaactattattgaacataattaaatacatgaattgatatttggagcatataaaaaattaaaatagtcatatagttcctcattatcttggataaaaaagtattgcacatttagatgaagatttctttaatttaaagagatttttaatattagaaataagtcttaaaatttacatatagtagcaaagtaaataagattgtggcaataaaaaactttattaagaaattatagtgtgctataatgaacaatgtattaataggggtaattataatatttttatattttacataataataaataaagtcaacaaaaaacgtactgaattttcaacaagtgcgggaattaaaagacataatttatggagggagataagatgaagaaaaacggcaaaagtgcagcgcttcttggggttattgttgctgtaatagcatttttagcttttgcaggatttaagggattagtcattggtgattatgcatttaaatcatttaattcagcaataactagaggacttgatcttcaaggtggagtttctgttcttatggaaattcaaaaagatgatgttactcaagaagaattagaaagtacaaagcaacatcttgaacttagagtaaataagttaggagttgctgaaacagttgttacaacagaaggggataagaggataagagttgatatcccaggacagtttgattctaatgaaattgtaaagagtctgagtcagtctggtaatttggtatttaaaggtccagatggagaagagattttaagcggaagtgatgttaaaaaggctacagctcagcttaatcaacagactgggaaatatgaagttggcttagaatttaacgatgaaggaacagtgaaatttgctgatgcaacatcaaaatatataggtcagaaaataggaatttatcttgatgatgaagcaatatcagaaccaacagttcaagttgcaataacagatggtaaagcatcaattacaggtagtgaaactttagaagaaaataaagctttagcaggaatgattaactctggtgcacttccagtaccggtaaaatcaatctcagttaaaaatgttggtgcacagcttggtgcaacagcatttcctaatgctattaaagcaggtgcaattggtataggacttgtattcttatttatgcttgttatgtacagacgtgaaggtttatttgcagatattgcgttaacattatatattttcttaatattaataatatttgtggaagttggagtaacacttacacttccaggtattgcggctttacttcttacaataggtatggcagtagatgcgaatatattaatttttgagagaacaaaagaagagcttagaaaaggagtatcagttaaaacggcaattaagagaggttcagaaaatgctctttcttcaatcgtagactcaaatgtgactacaattttatgtgctttaatcttatactttataggatctggatcagttaaaggatttgctataactcttatgataggtatattagtaagtttatttactgctcttatagtaacaaaattgttagttaatttagccgtagattgtggtttcctaagcaaaccagaacattttggagtgaagaaggaggctgaaaaacatgcttaagataatagaaaaatcaaagatatggatttcaatttccttaataatagtagtaattggattaggttttacattttttaaaggattaaattttggaatagattttaagggtggtactcaggtttcgatacaattaaatgatgaaataagcaaatcagatgttgatacaattgttaaagggtatgccgcagatgcaagtacaactatttcaaataataatgagtatgaaattaaatccactgatttagatagtgataaattatcatctataatgaatgaattaaaagataaatattcattagaagatacagctttactttctcaggaagaaataggagcttcagtaggtaaagaactaacaagaaattctttacttgcactttttgctgctggtgtggtaatgcttatatacgttgcaataagatttgaattcacctttggagttgctgcattagtagcaacactgcatgatatattaatgactataggtgtatatgctatattcggtattccagtaaatacaccatttattgcagcaatgcttacaatagttggttattcaatgaatgacacaatagtaatttttgatagaataagagaaaatactaaaaaaatgagaagagcgaatacatatgaaattgcagatacaagtttaactgaaactttagcaagatcggtatatacgtctctatctacattggcaacaatagtagctattaatatattagttccatcagttagagagtttactatacctttaatcgtgggaattatatgtggagcatattcttcaatattcatagcttctccagtatatgtgcttttaaaagaaaagacaggcaagaaaaagtctaagaaggcttaattactgggcttaataaaataaaacctccatgataaagtggaggtttttttatttcgtaataaaacaattgtaaaaatgtcgacaatcatttataatatatgtgttttctaattttatggaggaagaagccatgcgtaaattctgggaaagtatatattatccaaattatattactggatataacccatttatacttaaaggtatgaacaaagcaatagagagattagctttagctgttaataatagacagaaaattgtcgtttatggtacatataatgttgatgggatttgtgcagtttcatctttaattctagttcttagatatttaaatgctgatgttgagtatttaatatatgatagacaagaaaatgatgcaagaataaattcggtagacataaaagataatgttgattttttgggtgctgagcttttaataactttaggtgtaggattgaaatcacaagaagaagtagatttatgcaaaacgttaggcatagatttaattgttattgaaaatgaaataagtgatactgtgaatgattatatttacataaatccaaatcaaaagggttgtcagtataggtacaaagatttatcaacaagtgggataacttttaagttgatgcaagctattgcaatttattacaatatgaaaagtatcaacaaatatctagatctaatattaataggagtaaaatggtctagaggatcagctaaaggggaaaatggaatattaattaaagaaggcaataagttcttaatgaatactaataataatgggttgaggtcaataatagaatttaatgatataaaggaattcgacgattgtggcgtaaataaaataatagaatcactaatacctcctataggtgcagttgggattaccgataatgctaggatagtattagagcttttaactacaaatgataaggatagaactaatcagattgttaagtatctgtatagtttaaagaaaaaccatccaatgaagcaagttaaaagaatataattttatattaaaaataaatgaaatgaatattataattatagtatgcattttaatttatatataatgtgctatttaatcgaaaaatttatttttttatattaaaataggtactgtggaggaatcaaaatggatttaaaagaaaagatcagagtaattgaaaatttcccaaaggaaggaattagtttcaaagatattacaactctaattggtgatggtgaaggtttaaaagcttcaattgatgcaatagtagattacttaaaagataaaaacatagatttaattgttggaccagaagctagaggctttatttttggagttccagttgcatacgctttaggtgtaggtttcgtacctgtaagaaaaccagggaaattaccagcagaaacaatttcagtaacgtatgatttagagtacggaagtgatgaaattcaaattcataaagatgcaataaaacctggtcaaagaattgcaatagtcgatgatttattagcaacaggaggaactgttgaagctgttactaagttagttgaacaggcaggaggaattgttgcttctgtagacttcgttacagaattaacagatttaagaggaagagataaattacaaggctatgatgttatgtcattagttgagtatgattgctaaaattaaaagaaattaaaaaagtcgtgtttttgcatgactttttttgattattaaagtattttttttgtgcaatgttgaaaataaaagtaaaataatatataattattagaaagtgaggctggttatgaaaccagcctttgaatttacttttgaattttattaatatagaaggagagtattccttatggttgataaattgttagaaaacatcaataaaaattgccataatgttgatatagagttggtgaaaaaggcatataatttcgccaaggaagcacataaggaccaaaaaagagaatcgggagaaccgtacataattcacccaatagctgttgcagaaattttagctgaacttggtatggatacaaatactatagttgcagggctactacatgatgtgattgaggatactgattgttcatttgaagatgcatcaaggatgtttaatccagaagtggctaatttagtagatggtgtaacaaaacttactaaattaggtgaaatggagtataagactaaagaggaacaacaggctgataatgtaagaaaaatgcttcttgcaatggcgaaagatataagagtaataataataaagcttgcagatagacttcataacatgaggacacttaagttcatgccagctaataagcagaaaaataaggcaaaagaaacactggatatttatgcacctttagctcataggcttgggatgtcaaagattaagtgggaacttgaagatctttgttttaggtatcttcatgaaaaagaatattatgatcttgtaaaagacatagctgaaaaaagagtagaaagagaaagttatatacaagatatagtaaatgatttgtataaaaagctagaaggggcaggaattgattcggacattgatggaaggccaaagcatttttacagtatttataaaaaaatggttaataaaaataaaagtattgaagaaatattcgatcttacagccataagagtacttgttaattcagtaaaagactgctatggggttcttggtattgtacacacaatatacagacctattccaggcagatttaaagactatatagctatgcctaagcctaatatgtatcaatcactacatacaactgtaataggaccacaaggaaagacttttgaaattcagataagaaccttcgaaatgcataagactgccgaatatggtatagcggctcactggaaatataaagagggagacacagctggaggaaccgaggtagataagcagaaagagtttgagaagaagcttgcatggcttagagatatgcttgaatggcagaaagaaacatctgatgccgaagagtttatggaaggtttcaagatagatttattttcagatgaagtctttgtatttactccaaaaggtgttgtaattaatttgtgtagtaaagctacacctattgactttgcatacagaatacatactgatgttggaaataaatgtgttggagcaaaggttaatggaaagattgtacctcttgattatactttaaaaacaggagaaatcgttgaaatattaacatcacctaatgcaaaaggtcctaatatggattggctaaatattgcaaaaagtaatcagtcaaagagtaaaatcaagctttggttcaagaaagcaaaaaaagaagagaatattgtaaagggtaaagaactttttgaaaaggaattaaaaaaacaaggtgttaattatgctgatatagcaaaaggtgatgcctatgaaaagttcgctaaaagatataatattcattcaatggatgatttatacgcacttataggaataggaagtcttggagcatcttcttatattgtaagattaaaagaggataatggacttgataaatatgcaaaagaaagagaaaataaagaaatattaagcaaagtgattgaagagcagatagctaaaacagcaaagcagcgagaaccgaatagttatggtataacagttaaaggtgaaagtaatcttatggttagatttgctaaatgttgctcaccagttcctggtgatgatattttaggatatattactaaaggaagaggcgtatctgttcatagaagagattgcagcaacttacaaaatttaatcgaaaccgatggtgaaaaagttgttgaagtaaactggggcaaatcactaaatacatcatattttgcagaaatacaggtacaggcagaggatagggagaatcttctagcagatactatgagtgtaatatcagatttaaaacttcaattaagtgcggttaacgcaaatttaggaaaagaaggctttgcatttataaacattaagattaaaataacaagtgtagataatttaaatgatttaatgaagagaattaaaagacttaaaggtgtacttgatgtttatagagttaatagttagattagaataaagaaactattattagttaacatatatatgttagttaagttggattgaggtataaaatgagggcagtagttcaaagagtaacatcatcatctgtaacagttgatgaaaaagtaataggaagtataaacgaaggatttaatgtattactaggcatatgtaaagatgatacaatagaagacttacagtacataaaggataaaataataaacttaagagtttttcatgatgaaaatgacaagatgaatttatcaatattagatattaagggagaaattcttgctatttctcaattcacattatatggcgactgtagaaaaggtagaagacctaactttatggaagcaatgggtggagaggatgctaaggcattatatgataagtttatagaaatgctgaaggaatctaagttgaaagttgagactggggaatttggtgctcacatgaaagtggaaataaacaatgatggaccagtaacaattttacttgatagtaagaaaaatttttaaacgttagaacatataatagtttaatatacaaaggctgtatatgtttaaggcattatacagccttaaattattgactatataaactgagagggtgtgtgttaaatgttaaatctaaaaacagttccagcaggtgtttatgaagctaactgctatattttagttgattcagaaacaaaagattgtgcaataatagatgcaggcggagatgctgggaaaatatcagcagcagtagaaagcatgcagggtaatcctaaatatcttcttttaactcatggtcattttgatcatgttggtggtgtgaaagaaatatgtagtaaatatgatattccattttatataagtaaaactgatgaagaatacatggaaaaagataattcagtttttggaacacttcctaaagcttcaggttatttaaaagaaggcgatgtagttaaattaggtagtagagaaataaaagttattgaaacaccaggacatacaaaaggtggattatgctttttaattgatggaaagttgtttacaggagatactttatttcaaggatctataggaagaactgactttataggtggagatatgaaggaaattataagtagcataaagaacaaacttcttccacttggtgatgatgtagaagtttatccgggacatggaccatcttcttctattaaatttgaaaaaatgagaaatccatacttataaacagtttatagtactgagagttataagaaatctctatgggatttcttataacttatgtgttgtaaaagattttaaaaatcttaattaactgtgagtttcaattaatcataagaagtacatacatatataaaataaattatcgatggaagaaaggtcacattatggagataaaagttaatttgaataacttaaaatatagatatgaagtgtaccaattatttaatgtgtattttccaatgaatgaaattcagtttttagaaaaagatgaggcagattatattttttatattgatgaacagataatgaagtttcaatataaagaatattttaaagaagaatctttaggagaagatataaaaaattctctaaggagattcctttttctatgtctgagggatttaacaaatgatgtttatccatggggaatattaattggtataagaccatctaagatagctttaaagcttcttaatgaagggaaaagtgaagaagaaataatagatatttttaaagaaaaatatctagctcatgcagataaggcaagactatgcatggatgtagcaaaagcagaggaaagaatagtaaataaagataacaatacgattgcaatatatatagggatggcattctgtcctacaaaatgtatgtattgttcatttacatcgaatcctataggatctcataaaaagatggttatgccttatgttcaaagtcttatgaaagaaattaaagagataagtaaatacgtaaaagaaaaaaaacttaatgtagaaacagtttattttggagggggaactcctacttcggtaagtgatggagaatttatgatggtcatggatgaaatatatgatggattcataaaagatggaaacgtaaaagaatttactgtagaatgtggaagaccagatactttaaataaaacaaaactacagacaatgaaagattgtaatgtaacaagaataagcataaatccacagacaatgaacgataaaacattaaaattaattggaagaactcattcttgtgaagatataaaggaaaaattccatatggcaagacaacttggttttgatgacattaatatggatataataataggtcttccaggtgaaggtcatgctgaagttcttaagacaaaagatgagatttttaaattaaaacctgatagtattacagtacatggccttgctttaaaaagaggatccataatgtatgaaaattttgttcttaaaaaaggaatacctataacacctcatgaagaaattgtaaagatgtatgaggaaagcaagaatttagcagaaagtcttggactttcaccatattatatgtatagacaaaaaaatatggttggaaatatggagaatttggggtatgctaaagaaggtaaggaatgtatttacaacattcagatgattgaggaaagacaaacaataatagcattaggagctgcggctgttagtaaagttgtatttctagaagaagacagacttgaaagatttccgaatttaaaggatcttcatgagtatgttactagaactgatgaaatgattgaaagaaaaaaggaattattaaacagcctatataaatagttagcagttaacagttaacaggtagcagtttgatgatgaaatcttctgtgaagatttcttgaaatagatacaaaaaattaacaactgttaactgaaaactgttaactattaactggttaaatttggagggatagataaaatggcaaatgaaattcaagcaccaaagggtactaaggatatgcttccacaagatgcatacaaatggcactatgttgaaagtgtatttagaaatgttacaaaaacttatggtataagagagataagaacacctatttttgaacatactgaattatttttaagaggtgttggagatacaacagatatagttcaaaaggaaatgtacacttttaacgataagggtgacagaagtattacattaaagccagaaggtacagcgccagcagttagagcttttgttgaaaatagattatttaatgaagctcagccaacgaagctttattatataacaccagcatttagatatgaaaatgttcaaaagggaagacttagacagtttcaccaatgtggtattgaaatgtttggttcaaaagaacctacaatggacgtagaagcaattaaggtagctatggatactttaagtaaattaggattaaagagtttaagtttacacataaataatttaggatgtccaacatgtagagctaaatacaatgaagcattaaagaaattcttacaagaaaattatgaaaatctttgtgatacatgtaaatcaagatttgaaaagaatcctatgagaatcttggattgtaaagaaaagagatgtaacgaaataactaaaaatgctccacaaattttagactatgtttgtgaagaatgtgaaacacactttaatagtgtaaaagaatatcttgatgtattagaaataccatatgaaattgatcaaggtatagttagaggcttagactactatacaaagacaatttttgaaataatcaatgatgattttacagtatgcggtggtggtagatacgataagcttattagtgagcttggtggtccagaaatgccagctgtaggatttgctattggagtagaaagaataattatgactcttgaaaatgaaggaatagaaattccaaatgataatcttattgatttatatattgcagcaagaggcgaagaagaaaagaaaacagcatttaagcttgcaagcgacttaagaacattaggtggaaaatgtgaaataaatcatatgggaagaagcataaaggctgaaatgaaatttgcaaacaaattaggtgcggcatttacaactattttaggtgaagatgaattagctaataagaaaataaatttaaagagaatgagtgatggtgaaatctttgaagcttcattagaaaacacagaagaaattgttaagataataagtgccaaatagtaacaagaaaatattattgttaattgtaaagttttgatttatattatacaataaagagaatgatgtttttaaaactgtgaaattataaaattaagcggttttatcagttataaattaatagattaaattaatagtttaagaataattctaattggagttaaaaaataactattagttgttaaatgttaactgttaactgagatgaataggaggaataacaatgggtgaagctttaaacggattaaagcgtacaatgatgtgtggtgaacctagagaagaacatgtaggtaaaaagattactttaatgggatgggttcaaagaaacagaaaacttggaggacttgaatttatcgatttaagagataaatcaggtataatgcaggttgtttttggtgaagaaataaatgctgaggcttttgaaatagctaaaggtgtaagacctgaatactgcattgcagtaacaggagaagtagttaagagagaaagtgttaatgaaaacatgcctacagggtttgttgaattaaagtgtgaatctataaaggttctttcagaatctgaaactccaccaataataattaaagaaaacttagatacagcagaagatataagattaaaatatagatatttagatttaagaagacctgatatgcagagaatctttgatataagaagcaagactactaaggcaataagagattacttagaagaacataatttcttagatgttgagacaccagttcttggtaaatctactccagaaggagcaagagattatttagtgccatcaagaaattatccaggaatgttttatgcacttccacaatctccacaaatatataagcaattattgatgatgtctggttttgatagatattatcaaattgcaaaatgttttagagatgaagatttaagagcaaatagacaaccagaatttactcaagtggatatggaattaagtttcgtagaacaagaagatattatggagttaaacgaaggtttaatagcacatgtatttaagaaagtagcaggagtagatgttcagttaccaataaagagaatgacattcaaagaggctatggaaaaatacggttcagataagccagatttaagatttggaatggaaataacagatataacagaagatgtaaaagatatggatttcgtagtattcaaatctgcaattgaagctggtggatctgtaagagcattatgtttaaaaggtggtgcttcacttggaagaaaaccacttgataagttaggtgagtttgttaagacttacaaagcaaaaggtcttgcatggattcagcttaaagaaggtgaagtaaaatcttcaatagctaaattcttaactgatgacgttacaaaggcaatagttaatactatgaatgcagaagaaggagatgctatcttaatagtagctgataagaattctgttgtattcccaagtttaggtgcattaagattacaattagctaaagactttgacttaattaaagacaaaaatgaatttaacttcacatgggttacagaattcccattctttgaatatagcgaagaagaagaaagatttaaagcttgtcatcatccattcacagcacctatggatgaggatttagagtttgttgaatccgatccaggaagagtgagatctaaggcatatgacttagtattaaatggtgaagagctaggtggaggatcgattagaatccatgatacagctatacaagaaagaatgcttagagctttaggatttacagaagaaagagcatgggaatcatttggattcttactacaagcattaaaattcggagcaccaccacatggaggattagcatttggtttagatagaatgataatgttccttgctggaactgaaaacattaaagatgttatagcgttccctaagaatcaaaatgcttattgttatttaagtgaagctccaaatatagttgacgaaaaacaattaaatgatcttggaatttccattaatgttaaagaagaacaaaaagataacgaataaataataataataaagatggtatttattaaataccatctttattaataagtaaatgtataaatactatattcaatcaagagttttttgtttattggagaaaaatatgaaaatgtgtttagaattagataatcatattaaaaaattcagagaagacgaaaattattttcaattttttagggaactagcattaaaatatctaaatatagatccggattatgttagatgtgtaatggaagaactaataaaagtatgtgaagaaaaagaatattattctgcacatagttggtgtattctgtacattggttggagtgaaaatataaaagggaacgtgagtaatgcaattactttacataaaagggctttggagttttttgaaaatagtaataatgattgtggatgtgctgctgtatataatgcattcatggtagattatatacagattggttatttagagttaagtatagaaaatggcgtaaggggaattgaattttatgaaaaatttaatgataatgacgcaatagtagctttaatgataaacactgcatctgtttatgttgaatataagaattatggtgaagccgtatctattcttgatagaatcaaattatataggtatgatcatagactagattatgaagtagagatgaatgtcataaaagctgaatgttatctaggaactaaaaaatatattaaagcagaaaaattctgcataaaggctcttgagtgtattaaagaaaacaagtttattcaatgggaagacaaagctcttttaatactggcacaaatttattctaacactagaaggtatgaagaagcagaagagtattttttaagtgcacttaaagtttctgaaaaatataaaaatttttatatgcagggaaaagtactactcttatggggaatacaccatatgaaaaataataattatgataagtgtgaaaatatattcttggatgcaataaataggattggttgtagagaatatattcttataaaagaaagaatatattattatttaagcaaattatatgaaaaatcgcttgattatgaaaatgcatataagtgccttaaaaattcagtaaaatgtaaaaatattttaaagaatgacagtcaagttagtttgaaaagattaaaagaaaaagatatgatctatgcagtacaaaaatataaatctttgtacgacaagatggaaagaatatcaaatttaggaaaaaccttaactgcaaatcttgacgttgaaaagtttacatatgttatatatgaagagataaagaagctagtaatgttagatacttttgcaatagggatatatgaaaaaagcaaaaaagaacttaattataaaatagtttttaaaaatgataaaaaacttccagggatagtaagcaaggtagaagaaggtaaaagccttggtgcatactgtatatgtaataaaaatgatataataataaataatatggcgaaagaatattcaaaatatatatataaagttaagattgagaaaaagcagcttcaagaagaagcaaagtcaataataagtactccattattactagataatgaggcaactggagttatgacagtacaaagttataagattaatgcatatacaaatgaagatcttaatgagttgaagatattggcttcatatgttgcaattgccatgagaaatctacaattattcaatgaagtaaaacattttgctgaatatgatgttttaacagaatgttttaatagaaataagattttatcattaggaaagaaaatatatgatgaaagtaaagaaagtggatatgacttatgtgttgcaatggtggatgtagataattttaagtcaattaatgataactatggtcatggagctggagatcatattttaaaaagtgttgctaggataatgaaaaaaaatattggtgataatgattatataggtcgatatggtggagaagaatttattattatatttaataaaaagaatatagaacaagcaagtgatatttgtgagaatttacgtagatgcattgaaaagagtaagtataatattggtgacagatcaataaatgcaaccgtaagtattgggatttttgaaattcatggtaatataagctttttagatgggataaaatatgcagatgaaagcttatatgtagcaaaaaagacaggaaaaaataaaatagtaaaaaccagctagagtataaactgcttccggtcaaatagacaggaagcagttaaaaattatacgtatagatattttttattatagactttttatatactcgccaaaggttgttttaaattcaggactatattttttacaataattataaaaagaatcgtataaagcaattcttctttcgcttgttagaagatgtacatcattactatcaaaatcagcaagttctatttgtctgtttgttatatcatttgctgaaacattattatagtttttcatcatatcataaaaaatcataaaggtagttgttcttccaattccttctttacagtgaaagtggagccaactatcttctttcaaattttttattattgtaataaaggaatcaattgattcaactgaaggaagttcttcatctgttgcaaaaattctcatatatttaatgttatctgaagtgacaagagttttttcatcaaatacttcctctggagttatagttttattagggtgattgtgaaacgaaatagggacacctttttttattgaatctaactgggctttttctttttttaacacttgatcattacttaagcctttattagcattattatgctcattttcaaaacttattggaataccatttataaatccatgggattcttgtcttaagtcaaaatctattacaggaagatttgtatcaattgcttttagtaataatggtaaattcatttttgaaaattgttgactgccagatatatttaaattatcaaggcctgccaagttaagagtactattatttgctatgctttgaagttcgtttgattttctgaatttaaatggcatagtatcataattttcattatcttcaacaagataggaggtttctgagttattttgagaagtattagaaggttcttgaataaaagcatctattttatatggaattaaagaaaaaagtgatacagatactaaaaatgcagataataaaacattgaaattttttctttttatcataagtaaaatcacctcttaaaataattattatatggttaatatctgctataaaaaaatgatttattcaaaattaaaatacaaaaaagaaatataaacgataatgatcaattatttatagaaaaagatagtattttcaatattaaaagctttttgtataatttgttaattgactttttctcttgttaattttattattaaataattatgttctatatatttttaagatgatagtaaatgtattgtttattatttagtgtggagagtataaaaaagtgtgtaggagtttgtacatggaagtaaaaattgaagaattaaaagatcttgagatgtttaacaatatttcggaaagtacaattggtaaaatattagaagaaagtgatgttaaagaacatagagctggtgaaatattatttgaagataaagaagatgtatttactgtatattttgtattgaaaggtatagtatcattatacaaaataaatgagtgtggacagaagaaagtaatatttatgcttggaaaaggtaaaataattaatgaagttataataaaggaattaccagcatctattaattgtgaaatttttgaggatgcagtgattttaggaataaaaaaagaaaagcttctcaatataatgaaggaagattttgatttatgtaagaatataataatctctttatctagcaaaacaagacgattgtatagacagctgaaaaatactccatcatctataaaaatagaaaaaagacttgcagcaaagttatataaacttgcaaaagattatggagtagaacatgaagatggaatagtgatagatatggaaatatcaataacttatatggcagatcttcttggaagtcagcgtgagaccgtatcaagagctatgaaggtcttacagaaaaataatcttataaattataaaagtaaaaaaattattatttcaaattttgaaaaactagcattgttttttaaaacatcgtgatttttatcacggtgtttattttttttgtaatttataattaagctatgttgaaaatattccaaaaagaagtgtgggttttgttttctataggaaggtgaaaaaaataacaaagggatatttataagggcaaaattatgacaaaggagtattattatgggctacaaaattgttaatgaaagcttaaacgcgatttttgaaaagctatctaaagattactgcatttatgcaccaaaggtatttgaaggagatgggactttttcagatgttgatgttataagatatggtgaagtgtctaaagttgaagaaattgtttttgataaaaagtcagaatattcatttaaagaagttatttctccaataacacagactttattttactttacagaagatgaagtaactgtaccaaatgcacctaaaaagggagcaatagtatttttaagaagctgtgatatgcatgcattaaagagaatggaccagatttatttaaataatggaccagaggatttctactataaaaggctaagagaaaatactaaattcatacttatgggatgtacaaaaacatttgataattgtttttgtttagatatgggaagtaacaaaacaaatgaatatgatgcatatgtaaaggtagataaagactttgcaagcatagactgtaagtggtcggaattagaagaacttataaagatggaacaatttaaagaagaaaatgttacaccagatttcgttagtgaaaatacaattaaagttaacataccagataatatttcgactaaagtgtttaactcaaaaatgtggaatgaatatagtgaaagatgtattggatgtggaagatgtaattttgtatgtcctacatgtacttgtttcacaatgcaggatattttttatagagataacggaaaagtgggagaacgtagaagaatatgggcctcatgtcagataaatggatatacggatatggctggtggaattacgtttagaaaaccacaaggcgataagatgagatttaaagtaatgcataaagtttacgattataaaaaacgttttggatatcatatgtgtgtaggatgcgggcgttgtgatgatatatgtcctgaatacatatcattctcaaattgtataaataaacttgaagatgctattaaagaggtggaataaatgaagaacgaatatatcccatttatatcagaaataaaagaagttattaagcatacagatattgaatacacattcagaatgacttatgaaggtgatgtaaagccaggtcaattctttgaagtatctcttcctaagtttggagaagctccaatctcagtaagtggaataggaaaaggaacagtagatttaaccataagaagagttggtaaagttacaaatgaaatatttacaaattacgtaggagataaattatttcttagagggccttacggaaatggatttgatgtaaacaactataagggcaaagaaataacagtagttgctggaggaacaggtctttcaccagtaagaggagttgtagaatattttgcagaaaacagagaggaagcagaaaacttcaacttgatctgtggatttaagtctccagaagacatattgttcaaagatgacttgaaattatgggaagataaaatgaatcttattttaactgttgacaaagcacacgaaggatatgctggaaatacaggacttgttacaacatttattccagaacttgaaattaaagatataaataatactgcattcatagtagttggacctccaatgatgatgaaatttacagtacttgaaatattaaaaagaggagttccagaagaaaatatatggatttctcatgaaagaaaaatgtgttgtggacttggaaaatgtggacactgtaaaatagatgatacttacatctgcttagatggaccagtattcaattacactaagggtaaaaacttagttgattaattaggaggatttgaccatggatattaatacaaagaaacttaagaaaaatgcctttagagtttctaaggtaagaggtattggagcttcaagaatcagagtaccaggcggccttttaaaatctgaagttctaggaatggttcaggaaatagctgataagtatggaaatggattaatacatttaactacaagacagggttttgaaattgaaggtataaaatatgagcatatggatgaagtaacaaaaatgcttcaacctataatagaaagtcttgaaataaatttaaatgaaactgataaggggtatactgcatcaggaacaagaaatataagtgcatgtataggtaataaggtatgtccttttgctaactatgatactgcagaatttgctaagagaatagaaaaggcagtattcccaaatgaccttcatttcaaaatagcattaacaggatgttcaaatgattgtgcaaaagctagaatgcatgattttggaataatcgggatgacagaaccacagtatgatatgaatagatgtgtaagttgtggagcttgtgttaaagcatgtaaaagtctttctgttggagcattatctgttgaaaattacagagttgtaagaaataaagaaaaatgtattggatgcggagtatgtgttactaaatgtcctacaagagcatttacaagaagcaagaataaatactacaagttaactataatgggtagaacaggtaagaaaaatcctaggcttggagaagatttcttaatttgggttgatgaagaaagtataaagaaaataatattaaatacttataagtttgttgataagtatattgatccaaatgcaccagcaagaaaagaacatattggttatataattgatagagttgggtttgaagaatataagaaatgggctcttgatggagttgaacttggaccaaatacaataatgaaacattgtgttcattggagtggaataaactttaattcaattgataactaaattagttgatagttgatgttgaaatctccataaggagatttcaacaatgacatatctagattatattcccttggagtataatctttaaagattaattagagaataaatattttttataaaagattattaattttttaacaaactttgttaaaaaaagaacaatgtagaatgtgaaatttatttttataaaagagactaaataacaggtaataaagcttatagatatgtttaaactaataaacatataaatagctatatttatatatatcttaagaagaaatgaggaatacttatgaaaagagttcaatcgacttgtaatttttgtgctctggactgcaacatagatttctatgttgaagacaacaaaatagtaaaggttgtacccactaaaggatatcctgtaaatgatggattttcgtgtattaaaggactttcgctagataagcaacagactgtagtaaaaggatcgaaacttccaaaagtaagacaaaaagatggttcttttaaaactatggaatgggatgatacttttaaatatgttgcagataaattcattgaaatcaaagagaaatatggaagtgaaagtattgcaggtattagtacagggcagcttactttagaagagtttgcattacttggacatgtaatgagaaatcatttaaaagctaatcttgacggaaatacaagactttgtatggcaactgccgttgtagctcataagcagagttatggttttgattctccaccatacacattaaatgatgttgaactttcagatacagtaattttaataggtgcaaatccagttgttgcgcatcctatattatgggacagaataagaagtaacaagaataaaaaacttatagtaatagatccaagaaaatcagaaacagcacaacatgctgactattggtatggattaaaaggtaaaagtgatttagctttattttatacagtagcaaatattcttattgaaaagggatatgtaaataaagaatatatagaaaattatactgaaggatatgaagattttaaagaatttgctaaggcatatacattggaaaaaggtgcagaaattacaggattaaaagaagaacaaattttagaacttgtagagttgattcatgaaggaaaaagagtttcattctggtggacaatgggtgttaatcaagggtatgaagctgttagaacagctcaagctataataaatttagcacttatgactggaaatattggaagaccaggaacaggagcaaattcacttacaggacagtgtaatgctatgggctctcgtgcatatagcaacacagcaggactttatggtggtggagactttgataatcccgtaagaagaaaaagggttgcagaggttttaggtgtagacgaaagcgtattagcccagaagccaacagcaccatacaatgtaatagttgaaaagataatttcaggtgaaataaaagctttatgggtagtatgtacaaatccaagacattcatggactaataataagacatttatgaaagctgtagaaaacttagagttatttgtagttcaagacatatatgatgatacggatagtgctaagatctgtgatgtttatttacctgtagttccaggaattaaaaaagagggatcatatataaatactgaaagacgtatttcagcaatgagaccagcgcttgaaaaagaagaaaatgaaaagactgattatgaggtaatgcttggaataggtaaagcattaggaatgggagatttacttgataagtggcaaacaccaagagatgcttttaatcttatgaaagaatgttcaagaaacatgccatgtgatatgacaggtgttgactacgatgggttagtagattcaaacggaatacaatggccgtttagagaaggagaagaattgaaagaagatcaaagacgtttatttgaagataatcttttctatactccatctaagaaagctaaattcatatttgaagatgttaaggaaaatccgttacctacaagtgaagaattccctttaatatttaatacaggaagaggaacagtaggacaatggcatactcaaactagaacaagagaagtaagatttattgaggatgtaagcatagatacagcatatatatttatgaacactaaacttgctgaagaaaaaaatataaaagaaaatgatatgataagagttaattctataaatggtgaatctgcagattttatggttaaaattacagataatcaaagatatgaagaactttatgctccaatgcattatttggaatgtaataagttaactccatcaatatatgatccatattcaaaagaaccatcatataaaactacaccgattaatatagagaaactttaggaggaaaatcttcatgaagagaataaaaatagacagaagtaagtgtatcggatgtttaacttgtgttacagcatgtgtagtaagtcatgaaagctgtgattcaagaaacagagtaacaattgacagtaagactaaagcagctcctattttctgccgtcactgtgatagacctgagtgtgtatacacatgtatgacaggagcaatgcataaaaatgatgaaaatggctttgttgaatatgacaaagacagatgtgcaagttgttatatgtgtataatggcatgtccttatggcgttcttaaggcggatagattaaagcagaaggaaataatgaaatgtgacatgtgcactagttgtagtgaaaaagatggaagcaaaccaatgtgtgttgaaaaatgcccaatgggtgctataactttacaggaggtttagtttatgaaatacgttgtacttggagcttcagcagctggaataagcggagtgaggcaattaagagctttagataaagatgcagatataactttagtttcaaaggatgataaaatttattcaagatgcattcttcatcactatatggaaggaataagagatgtaaagaagcttgaatttgttgaagataacttcatagaaaaaaataatattaactggattaaaggtatttcagctacaggtgttgatgtaaacaagaaatatgtaactcttgaaaatggtaatagtatagaatatgataagcttcttattgcaacgggagcacatacattctttccaccaatacctcatttaaaaactgcaaaaaattcaattggattccgtaactttgatgattgtgaaaaaattatggagatgtctaaaaactgtaagaacatagttgttatgggagcaggtcttgttggaatagatgttatttcaggtcttttacatactgattgcaatgtttctttagtagaaatgcaggatagaatgctttcaattcagcttgataaaaaagctgcatctgtttatgaagaagcatatagtgcaaagggtgtaaaacagtattatgaaaaaggtgtaaaagaacttattgttgatgaggatggaaatataaaagaaattttattaacaagcggagaaactattccttgtgatttattaatatgtgcagctggtgtaagagctaatgtagaatttttacaaaatagcgaaatagaatgtgacaagtttggattagtaatagatacacaaggaaagactaatgctaaagatgttttcggagcaggagatgtaacaggtagaaacccaatatggccaactgctgttaaagaaggtataattgctgcaaacaatatgtgtggtataaattcagaaatgacagatttctttgcaagtaagtcaacaatgaatttcttaggtattccaacaatgtcacttggaatcaatactcctccagatgaaacttatcaggttgaaattgaaagtgatgatgatggaaactacaagaagataattcataaggatgggaagatttatggagctattcttcaaggtgatttatcatattcaggcgtattaactcagcttataaaaagaaaaatagatgtatctaaaatagaaaaaccattgtttaaaatagattattctgatttcttcaatgaaaaatcaaattttgaattttattatgaagaagtttaaatcagtttaagttaataatttataatttgaggatgaactctattaagttgtatgtttaaaaatatataaagatcttctgaaataatatcaaccataacttttaactgataaatataaaaatatttaataaggggaatgaacaccaatgaataaaactttctttcaaaagttagaaaatttacctgttgcaattctgccgactatggtaggtgcagcaacacttggaactgtatatgcaaatttaggatttacatgtataaagcatataacaatatttgcagttgcagtaataatgattgcttatactgcaaaaatatttggccataataagactgtatttaaagaatatagtaatacagtaccggcgagtttatatgctgggttcacaatgcttacaatgatacttggttcttatatatttgattttaatgctacaattggtaaagctgtatggtttataggattaatccttcatgctatccacatattagtttttacatacagaaatgtaattaaaggtgttaacattgatacttttgtaccaagctggtttgtaacttataatggaatcatggtttctacagtagtaggtggagttatgaatgaaccatttatctgcaaaatagttgtttattatggaatatgcgtatttgctcttataattccatttatgatttatagattagcaaaacatccaataaagaatcctatgtatcatacacaggctatagttcttgcaccatcaagtctttgtcttgtaagttacataaactttattaaagagccaaatatgattttagcctatgcattatactttgcagtattatgtgctttaatatttataatatataaaatgccaggattcttctcatttgaatttaatccaggatttgcagggttaacattcccaatggcaataggaattgttgcatcaacaaaaatggcaggattattaacagctcaaggttatgaattcctaggaaatattgcaaaacaaattagtggaattcaaatttatatgacaacagcaataataagctttgtgctttataattttgcaagaatgcttgttagaagctataaaaaataaaaactatataagttctaataaaaaacgctatagtgatataaagttttaacatcacgtgtcaattgtaaaatgtcaattgagaaagggtgagatatctatggaaatatgtgcattagttcttgcaggtggaaaaagttcaaggatgaatggaaataataaggcttttttaaaatatcaagataagactttcattgaaaatatattagaggttttaaaaaaatttaataaaatttatatttctgtagataacatagaaaaatataattatttaaattatgaactcatagaagataaatataaggaaattggacctattggaggtatatactcagcattaagtgagattcatgaagagtatgtttttgttactgcatgtgatatgccaaaaatatctgaaagaattatagaaattctaaggagaaatttaaataaagatgataaatgcatagtatttaaagatgaaaatgaaaggatatatcctcttggaggaatctattccaaagaatgtcttccttttattgaaaaaatgatttatagtaagaattataagttgaccgatcttgttaaatatgttaacggaaagacaatatctttaaaagatgtggggcttcataaggaagaattactaaatatcaatactccaaatgagtataatgatttaaataaatatatataatgaataattaaataatctccgaacaactgtatctaaggagtaaatctatgatgcttttgtcaaacagaatgtatgatgatagtttaatatactacattttgtttcagggttctatgggaaactatattgccttccgtgtttgaaaaggaggattatttaaactaaaatattatttatacattttatacaacaatacatttacaaatgatgttatatatgacttattattatgtcaacagcaatgataggattttgcttttatgtatttttaataatattttagtttgaatagttttatgataattttagcattaaagattgttataagctgaatttttcatatcctttttattgaggtgatgaatgattcagcttattttaatattaaaatgaaaaacaaacttattttcttcgtagatgtagaattaagatttaacgatagattaaaaaggggtttaatataatatgaaaaaaatagaaacagtaaatgctgtagggcatgtactttgtcatgatataacaagaatagttaaggatgttgttaaagacactccatttagaaaagggcatgtagtaacaaaagaggatataccaatgttactttcactaggaaaagaacatctttatatatgggaaaagaaagaaggtatgcttcatgaaaatgaagcagcagaaattctttttgaaatatgtaaaaatgaaaatatgaaaggaacagaaataaaggaaggaaaaattgaattaattgcagaatgtgatggtttattcagagttgatgttaatagattagatgctatcaatgatcttgatgagattatgatagcaacaagacatactaactatgcagtaaaaaaaggtgataaattagctggaacaagagttattccacttattattgaagaatctaaattagaagaagcaaagaaaatagctaatggtaagccgcttttagaacttcttccatatagaaagatgaaagctggagttgttacaactggaagtgaagtttatcatggaagaataaaggatacttttacacctgtaattataaataagcttaaagaatatgggattgaagtatgctggcacaaaattgtagatgataaaaatgaaatgataatagatgccataaatgaaataaaagacagtggagcagaaataataacgtatggtgcgccagttcttccaggagcaatgtttcttcttggatatttcaatgatggaacaccaattatgggacttccaggctgtgtaatgtattcaaaagcaacagtatttgatcttgttcttccaagaattgcagcaggacttaaggtaaccaaaagagacataagtagaatgggtcatggtggattatgtttttcatgtaaagtatgtacttatccaaggtgtgagtttggtaaaggcgcattataataaaaggagcaggataacaaatgaaatttagaatagagcttgaagaagcagtttcaataatggaagaaaatgttcaagaaatagatgaaactgaagacatacttcttgaaaaagcatgtggaagggttttatatgaggatatatatgcacctataagcaatcctccatttgaccgttcacctttagatggatatgcacttattgcagaagatactaaaaatgcaagcagagataatcctgtaactcttaaagtaatagatgaagtatttgcaggaggatattctgaaaaagttttaaatcataaagaagcaatcaggataatgactggtgcaaaattaccaaaaggttgtgattgtgtaattaagcaggaaaatactgatgaaggtatggagactgttaaaatatatgaagaacttaaaaagcatgataattactgttttatgggcgaagatgtacagaaaaatactttattaatgaaaaaaggagaacttttaaattatatacatataggtattttgtctggaatgggatatgacaagattaaagttaagagaaaaattaaagctgcactgctagtaactggtgatgaagtatgtatacctggaaagccacttaaagaaggaaaaatatatgatagtaatatgcatgtatttagtgccaggctgagagaacttggaatagaggttgttaagtgtgaagttttaggtgatgattataaagtagttggagataaaataaaatctgtaattaatgaaattgatatagtcttaacaacaggtggtgtttctgttggaaagaaggatatccttcatgaagcactaccatacataggagctgagatactgtactggaaagttaatcttaagccaggaacacctgcaatgttttcgttatatggtgggaaacctattttaagtctttcagggaatccatttgcatcccttgcaacttttgaacttcttgcacggcctgttttaggaaagataagtggagatatgagaattaatactaaaagggttattgcaataatggatagtgattttaataaatccagtaaagtaagaagatttataagaggatactatgaaagtggtatagttaaattaaataatggaaaacattcctcaggaatattatcatctatgattggatgtaatgcattaattgatataaaacaaggaacagagaaattaaaaattggcgacacagtaaatgtgattttaatatagatatgaaagatagaaggaaagaagaaatatggaaaataaattaactcattttgattcaaaaggaaatgctgtaatggttgatgtatctgaaaagaatataactcaaagagttgccattgctaaaggaaagatatatgtaaataaagctgtaatagaagcaatagtaaatgatactgttgaaaaaggagatgtacttggagttgcaagagttgctggaataatgggagtaaagaaaacttcagaattaattccaatgtgtcatcctcttatgataactaaatgtagtatagattttaatgtaaatgaagaagaaaattatattgaagcagtatgcacagctaaagttaatggaaaaacaggtgtagaaatggaagcattaacaggcgtaaatgttgcacttttaactatatatgatatgtgtaaggctattgataaaactatggaaatttcagaagtacacttagctaagaaaacaggtggaaaaagtggagatttcattaatgaaaaataggaaaaagcctgttttaattgcagtcagtggagttaaaaattctggaaagactactttgattcaaaagcttataccaaaattaatagaaaaagaattgaaagttgcaacaataaaacatgatggacatgattttgatgctgatgtctgtggaactgatacatacaagcataaaaaagcaggagcctatggaactgcaattttttcgaaaaataagtttatgatgattaaggagcaggaagatacgaaggaggaagaattgatatcatactttaaagaagctgatgtgatacttttagaaggatttaagaattcagattatcctaaattagaaataataagaaaaggaaattcacataaaagtgtatgtaagaaagaaacacttttagcaatagtaagtgatatggattataatgaagagttaattaaaacacttgatttgaatgatatagataaaattgcagaattcctgctagaatatataggagagtgcggtatatgatagatatttacaaaagaaagatagactatattagaatttcaattacagatagatgtaatttaagatgtgtatactgtatgccggaaaatggaataaatctagtgaaacacgatgatatcttatcatatgaagaaataataagattatgtaggatgttttcaaaacttggaataagtaaagttaagataacaggaggggagcctcttgtaaggaaagatgtttataagcttattaaaggaataaaggaagttgaaggaattgaaaatgtaactttgactactaatggaatactacttgagggaatgatagatgatcttgtaaaaagtggtcttgatgcagttaacataagtatagatacattaaaagatgatacctataagtctttaacaagagttggagatgtaaacaaagtattaaatggtattaatgaatgtttaaaatataaagatttaaaggtaaagataaattgcgtacccataaaaggtaaaaacgaagatgaacttattgatttattaaaattatcaaaggacaatgatataagtataagatttatagaaatgatgccaataggtcttggtaaaaatatgaatggacttaatgatgaagaagtaaagtcattaatagaagataatattggaaaattaacagcttttgatggaaagcttggaaatggtcctagtgattattttactcttgaaggatataaaggaaaaattggttttataagtgctgtaaatcataagttttgtgaaacatgtaatagagtaaggcttacatgtgaaggcttcttaaaggcatgtctacaatacgatataggtacggatttaagaaaaatgcttcgtagtggaaaaagtgatgaggaaataatgaatgcaatagaagcaactatatataataaacctgaaagtcataactttaaacttataaaagatcatgaagaaaaggttgaacatcgtgcaatgtcgcaaattggagggtgaattcagttaacagttaacagttaatagttaacaaggaacagttacagttgaaaattgatagtttatttagaacaagaaaagaaagaagaggcagataggaaatgggaaaagttatagcagtatgtataagtgaaaaaagaggaactgttaagaaaaatattcaagagtgtaatgttgttgaaggatatggattagaaaatgatgctcatggtggaaactggcatagacaggtgagtcttttatcttatgatagagttaaagaattcaatgaaaaaggtggaaatgtaactgatggagattttggtgaaaatcttttaattgaaggttatgattttaaaacacttcccgttggaactagatttaaatgtaatgatgtagttcttgaacttacacaagttgggaaaaagtgtcattcccattgtgagatattccatagagttggagattgtataatgccaagagaaggtgtatttacaagagtaattcatggaggaaagattaaagtaggagatgattttgtaatatgttcagagtagcagtaataacttcaagtgatagtggatatgaaggtaaaagagaagataaaagcggacctgaaattgaaagaatagttaaagaatatggttatgaagttgtacatacaatcatacttccagatgaaagaaaaatccttgcagatgagatgatgagaatagcagacaataatatagcagatcttattttaactacaggtggaacaggattttcaaaaagggactggacacctgaagccaccaaagacattgttgaacgtgaagttccagggataccagaagcaatgcgtgcatacagtcttcagatcacaaaaagagcaatgcttagtcgtgcagcagcaggaattcgtaaagaaacattaattataaatatgcctggaagtcctaaggctgtagatgaatgtcttcaatatataataagtgaattggatcatggtttgaagatattaaaaggtacagcatccaattgtgcaaggaagtaaaaagtactgtattccttaaagaaagtataggaaaccatgctaaaattaaaagcacatataattatcttttgttgtgcaccaaaagataatttatgtgctttttgtgtgtttggagttttgtaatataatggctatatcattaatggcgattagaataatatagcatcattgcgttatatatatcaatgaactttttaaaagatcactaataagcttttttagttgtatccttatgaaagagagggagtctctctcataaggtttagaaatacacaataatttctaaggagtataaatttcaattagaataattttgagtagtattctactactaatgaatcattaatttgaattggaacttcacttctttcaggatatcttaaaaggcttcctgaaaattcagcttcattctttgttaaataaggataaacattaagtatgttagataagaaattatctctgaacatttcattcttttgagatttttctcttaaagcaacaacatcaccaatattaacattgaaagatggtatatttaccttttctccattaactaaaatatgtccatgaacaaccatttgtctagcttgtgctagtgaacttgcaaatccaagtctaaaaactatattatcaagtctgcattcaagtcttttaataagggcatagcctgtttggtctttatctttaaatgcttttcttgcgtaagttgcaaattgcttttccattacaccataataagctcttaatcgttgcttttctaatagttgtgtaccataaggtgataatttttttgaatctctagcgctgccatttccagctcttttcattgctttaggatgaccgtttacgtttaatcctaatcttctacataacttaaatcttggtcccatcatttttgccataatttatcatctccatataaagatttgccgcgataaaattaagcccaaaaataatataacataaaaaaagataaatgtaaatgaaattcattgtcattttataaattttattaaaatagattatatcctaaaaatagaatataatttagagtaaagaatatatacaaaataacaggggataatatgttaggaacaatagtgaatgctttagcagtaataggtggttgtataattggattaatagtaaaggaaaagcttactgagaagatgagcaatacaataatgagtggactggctttatgtgtattatacataggaataagtggagcacttaaaggacaggatactctcattataataatttgtatagctgttggagcattggttggggaaattattgatatagacaaaagattaaatgatttaggtaattttatagaaaataagattaatttaaaaaagaaaaataaagattcagaaaaaatttctatatcagaaggatttgtaacatcaagtcttttattttgtgttggagcaatggcagttgtaggttctcttgaaagtggtcttcaaggaaatcattcaacactttttgcaaaatcaatattagatggagtttcatctataatatttgcatcttctcttggaataggagtaatgctgtcatcagtggcaatattagtttatcagggaagcattacacttcttgcgggatgtttatctagtgtacttacagatacagttataggaaacatgtctgccattggaagtattttaattatggggctgggtacaaatatgatcggtgcaagtaaaataaaagtagctaatttattgccagctatatttttaccaataataatatatttggtacagattttaatttaaaagtttaaacaaaaaatccctattttaaaaattaaagtagggatttttttgttgttatatttaatcaattaagaatttttctacaagtttagcagcatcttctatacatccaggacatgaacgtttaacaataccatcatcaattccctttagttctttacaaattgtagttgaattcatttctttaaattcttcagccaatttttttgaaagagcataagtacttcctttagtactaccaggattaacaagtccattactgttttttaaaccagcgagcataagaactcctgtaagagctccacatgtactttgcattccacccattccaagtccaaatccttcagaaactctaaatgcagtttcttcatccattccaaataagtcacaatatgtgcaaagtattgcttgagcacaattatatccttgagcatgtttttcagctgtaagatttattctagtttccatttccttacctccacaataagaatttatgtataaaattaataatttaaaaatttatatatggaaagtatacaattatataaatttttttgcaaacttttataaattaatgaaatcgtaaaaattaggtgaattatagatttacataggcattattaagtttaaattttgtaaatatttagattgagtagaatacaagggttattagaaataaataatacgaaataatatgtaaagcgaatttagttttaaaaaaaagtaaaaagttaaaatttacaatattatgttttttaaagtaataaataaaaattcatcgacataagattaaatataaaacttataaagtgtggttaagggaggggatttttattgcaagagttaaatttagacaataacagaataatgcttgaaaaaaagaaattatcaagaaatacgtatgaatttttaaaacggcttatggatattatatgttcaatgtcagcactgatagtattagcacctatacttatagttgttgccatacttataaagattgagtcaaaaggtccagtaatattttcacaagaacgtgtaggtattaataataaaaagtttaaaatgtacaaatttagatcaatggttgtgaatgctgaggatatgaaggaaaaattagaaaaacaaaatgaaagaaaaggaccaatgtttaaaattaagaatgatccaaggataactacaataggaaggtttataaggaagacaagtatagatgagttaccacagcttataaacatattaaagggtgaaatgagcatagttggaccaagaccatcacttccaaaagaagtaatacagtttgaaccatggatgctagaaagattaaaggtaaaaccaggacttacgtgctattggcaggttcaaggacgtgatcatatagaatttgaagattggatgagacttgatgtaaagtacgttaaggatagaaattttctattagatataaagttgatatttaaaacattttttgtatttttaggggaccaaaatgcaagttgatttaaaaaatattttctgaaaaattttaataaaatgaaaacacaaaagcatcttcattgttttaatgggatgtttttttattggttacataaaaagaatacgttaacattaagatgaattaaaaaataatgcatatattaaggaagcttttttctattatatactttaatctattgaataaataaaattccaccttgtcttgtcaattcaagataagatggaattttatttttaaaatcaatatatattatttctaattaaattacaaattgatgagactactaaatcgtatcctgacgatgttggaagatcatttacaatcaaggagtctttttcggcatctgatttttcaaaataattatttgtgtctgcataagatatgttgttactagaacaaatatgtttcatttctgagacatattcattatcgttagtaagacttggaggtagtaatgctgtaattaagcaattataatttctgctctttaattttcctattaaatcactgtagttttgagcaaagctctttaatgaactgttatcttttgcatctttaagaccaaaggataatataacgagatcaaagtctttaaggtcagggtttgaatctaaaagttgaaatccatttataatagtagcatctttttgctgcaaatattgaaaatcacagttaacattataagttgttttaaagaagctacttaaattttcagctactggataggatgaattatctgaaataagaccggaagtcagttcatctcctaataaaagaatttttacattttcatttgctttgattttattatacacactgttatatttatcagaattataattgataggacttcctaaattataggtttgctgagaagtttgaactatcagggcatgctctttttttatacccataaataaaacagccgttaatattattactaaaaataatataataaaatttaatttagttttctttttcattttcatgataaaaaaccagcctttcatatatattttgaaaaatatgttaatcaatatattactaaacatatgcataatagtttgataatagaaatagttttttttattaaaatacgaaaattcagctttaaatcattttttatagttaaaaattagatataaaactaaaaaaagtaataatttgattcacataagaatatatacataatatagcttttgaaaggaggaaattatggaagaagaaacaattagtatctcagaaataatccagattataaaatctaagtggaaaataattataatagtaactctaacagctaccataatcagtgcattatatagtttctttttagtaacaccagtatatacttcaagcttaaaggtgtttattggaaaggatactatggaaaaaaaggagtacagtacaggagatgttactttatatcaaaatttattaaaaacttattctgaattaatcactactgatgatttaattgaaaaggcagttgagaaaagtcatcttgatgtattgccagaagcagtagcaggagggctttctgttagtcaaggagaagaaactcagataatgacaattaaatacaaaaatgccaatagtattttaagtaaagatgtattggatgcagtaactcaggaatttattaaagaagcaaaagaattaataccaaatggaagtgtaaaagtggttgagagttccaagtatcctatatatccagggaatttaaatagtattaggaatatattaatgggaattattgtaggcgcattcttaggtataacattagttttattcatggaatatataagcaatacatttaagacaagagaacagatagaaactagtattggaattcctgtaataggtttaataccacatataggagaagaaaagtaatcggaatatatgaaatagtaaagattaaaatactatatattgtttttgattgtaatatttaaatattaatggggatatctaaaatattatgctatttaagatattcctgatttttttgtaataaatacaaatttattcacataaaatcaatgtatataacaatatgttacagtaattttggaaagaaggtaattatgaaaatagttgtatcaggaacaggatatgttggattagtcacaggagcatgcttagcagaaaaagaccataaagtaacatgcgtagatattgatgaaaataaggtagagatgatgaaacaaggcatttcacctatatatgaacctggtttagatgaattattgaaaaataactatttaagaggcaaattaaattttacaacagattataaaaatgcatataaagatgcagatattatatttataggggttggaactcctgaaaggtctgatggttctgcaaacttagattatgttttcaacgtatgtacacaaattgctgaaaatgttgaaaatgactgtcttgtagttgttaagtctacagttccaataggaactaatgatagagttgaagagtttttaagggaaagtttaaaaaacaaagttcatattgaggttgcatctaatcctgaatttttatctcaaggaacagctgtaaaagatacacttgaggcaaaaagaatcgttattggtgttgaatcaaaaggtgcagaagaattgttaagagaagtttatgaaagatataatcagccaattgttgtaacaaatagaagaagtgcagaaatgatcaaatatgcatctaatgattttttagcactaaagatttcattcattaatgaaattgctaatttttgtgaatttgttggtgctgatattgaagatgtaacaaaaggcatgagttatgatcctagaattggagataaattcttaaaagcaggcataggatatggtggatcatgttttcctaaagatacaaaggcacttcactggctttcaaatgataatggaaatgaaataagaacaataaaagcaactattgaagtaaatgaaaatcagaaatataaattatttagacaagcaaagaaaagatttggaaatttaagagggttaagagctgctgtacttggattaacatttaaacctggaacagatgacttaagagaagcgccttcaatacctaatattagaagacttttagatgaaggagtacaagttgttgcttatgatccagtaggagagaataatttcaaaaagctttatccaagtgaaatagaatatgttaataagccagaagaggcaattgcaggggctgatgttgtatttatttttacagagtgggatgaaataaagaatattaaaatagatacttattgtaacctaatgaatactccaattatttttgatggaagaaactgctataagatagctgacataatgaatgaaaaagtagattactattcagtaggaagaaaaacaatattaaattatgagaaatcattaaatatagaagttgcagctactaaaaaataactactttgataaggaaggtgaagttatgttatgtgcacttataatggcaggaggaaaagggacaagattctggccactatccacagaagaaaagcctaaacagtttttaaaccttataggtgatgaaacaatgatacagatgactgtaaatagagtaaagccaataataccgatagaaagaatatttatatgtactgtttctccatatgttgatttagtaaaagaacaacttccagaacttccagtggaaaatataatagttgaaccagaggggagaaatacagcgccatgcattactctttcttcaatgataataaagagaagatttaaagatgcagttatggcggtattaccttcagatcatttaataaaaaatgaagaaaagtttagagatattattgtaaattgcagtaatttcattaataaaaatgataaagcaataattactgttggaatgaaaatggatagaccagaaactggatatggatatataaaatatagtgataattatgtagaggtgaatgaagaaagattcataaaagtagataaatttgttgagaagccagatttagtaaaagcaaaaagatatttaagagatggtaattatctttggaatggcggaatgtttttgtggaaggttgaaaatatattaaatgaaataagagaatattgtccaagtatatatgaacctttaaagggtgttcaaagtgtagatataaatgaaataaaagatgtaattaatgaaaattataataagacggaagctatatccatagattatgcggttttagaaaaatctaaagagatatatgttgtacctgtagatattgggtgggatgatattggaacatggaaatcagtagagagatataaaaagaaagatgattttaataatattattgaaggaaatgcaagggtaattgaatctaaatcaaatattgcaattaataatgataaaagagttgtgatgattggaattgaagatgttatgactattgagactgatgacagcatttatattgttaataaggggtatatggataatcttagagattatagagagagtatttaaattaatcaatattaatggaggaacaatatgtcaagaattaaatttttgaatacacagatagataatgtaactatggaagaagcaatcactagaattgataaattaatagcgtcagatagaaatagttatgttgttactcctaatgtagatcatattgttaaacttgaaacagatgctgaattgaaaaaaatatatgaagatgcagacttaatattaacagatggaatgcctttaatatggatttcaaaattaaaatctactccaataaaagaaaaaatatcagggtcagatttatttccgaaaatttgtaaattaggggcaattaaaggatataaattatttttacttggagcagcagaaggagtagctgaaaaagcagcagaaaaactaatgcaacaatttgatggattaaatatagttggaacttattcaccaagttatggatttgaaaacaatcaagatgaaatcaatcatataatagaactaataaataattgcaaaccagatattttggcagttggattaggagcacctaaacaagaaaaatttatatataagtataaagaaaaattgaaagtaccagtttctttagcaattggagctagcattgattttgaagcaggaaatataaaaagagctccgatttggatgcaaaaaaacggacttgagtggttttataggttatgtatggaacctaagaggatgtttaggagatatctagttgatgatttgaaaatattaggaataagtcttaaatataaaaattaaaatttgtgagttaacaaaggagtagaagattatgattaatagaataagaaatcttataaaaaagatatatgtgtataaattaatacgtttaggattaaaagttggtgaaaattttcaaatagaaaaagggtgccagattgacacaccatttgcatggctaattagcatagggaataatgttacattagcatctaaggtctatatattagcacatgatgcaagttgtaaaaagcatgttggatataccaaaattggaaaagtaaatataggagataatgtttttataggagcaaattctactatattacccaatgtatcaattggaaataattctattattggagctaatagtttagtatctaaagatgttccagaaaatactgttgtagcaggaaatccagcaaaaacaattgataaattagagctatttattgataagaataaagaaagaatgaaaactactaatttatatgataaaagttggacactaagaggaagagttacagaagaaaaaaaaagaattatgattgaacagttacaaagcaaatttgggtatatagattgattaggaggttagtacgaatttgataaatgtattgatgattggatcagatttatctgttaaaggtggaatgactacagtagttaaaagttttttaaataataattttgaagatgttaatataacctatgtaccaacacatatagaaaatgtaggtaaaatgtataaaattttattttttattaaatcattaataattattgttaagaatttaattattaatgatgttaatattgttcatattcatttatcagaaaggggaagttttttcagaaagttaatagttgtattaatatgtaaagtttttggtaagaaagttataattcatttacatggagctgattttaaagaattctataataacaataaatatatccaaagcgcaattaagtttatgttcctaaaatgcgattgtgtaatagttttaggtgagaaatggaatatatttgtaaagagtattgatgaaagaataaaaacatttattttaagaaattcagtagaattaatggattattgcgtagagtataatgacaagaacgtgaatatattgtttttggctgtcttgattaagagaaaaggaatatttgatttgattaaagcagtagataagattagatatgataaagaattaacagaatacaatattaagtttgtattagcaggttcaggaaatgatgaagtagtaataaaaaggcagataaaaaatctagacttagaaaaatattttatatttaagggatgggtagatggaaaagaaaagatagagacaataaaaatgagtcaaatatttatattaccttcttataatgaaggattaccaatgtcaattttagaggcaatgagttttggaatgcctattattacaactaatgtaggaagtattgatgaagctgtacaaaataatgttaatggttatattgttaatccgggtaatgtggaggaaatatatgaatcaattaaaaaaattattgttaatcatgatctatggaagaaattttcaaaacaaagtaaatatacaattaaagaaaaattcaataaagatcaatattttataaagatgaaaaagctttattatagtatttaaaggagtagtaagatgataagcgtaattgtacctgcatacaatgttgaaaagtatattgaagaatgtttgttaagtttggtaaatcaaacttataaagatattgaaataattataataaatgatggttctacagataaaacaaaagaaataataattgaatatcaagagaagtataaaaatatcacaggttataatcagaaaaataatggtgtttcagtagcacgaaatttaggattaaaaattgctaaaggagagtatgttatatttgtagatccagatgattatttagatagtactatgattgaaaaaatgcatgataaattaaaaatgacagattcagacttagttatatgtgggcataatgtattctacgatgaaaatccgaatgaattcatggttaatctaattaatgtagatgaagatactgtatatactaatgttgaagttttggatatgatgttaaatttaaaagtaaaaggatatgtatgggacaaactatttagaagaaaaatgttaatagaaaataaattcaattttgaaaaagatagatatgttcaagattggttaccaatagttaagcaagtatgtttttcaaaaaaaatatcttttgtgaatgaacctctatattattataggcaaagaaaaacatctactatttataaaaaaaataaaaaattgatagaagattattctcataccgttaaagaaattaactattttttaaaaagcaatcaaatagagataaataaaacaagtaaagaggtgttcgatactgagacgtactatactatatgtagacattattatctttattattcagggatattgaatataaaagatatatattcaagctttaataaatctaaatatagtgaattttcacaatttaatatattatatattttgaattctaaaataaataataagcttaagataaaggttatattatggaaaatgaggttgtttcatctattttttaaaatagcatagaggggataataagatatatgaaatttaatataagtattattattatattattatttcaaggaagcattggaaatattatacctataatgaattattttgatgaatttttaataataatactggtaataagaatattatttatgatgatgaaaaggaaaaacgtgaaaataagtaagaatcatttggtaattatatttttatctgtttgtatctaatagttggtatagtatctaatatgaatagtaaatttcttgttgagtttaaagcgtatttatcaagtggaattttaagtatgaaattcgtaattattttcatattatcttcaatggcctttaaagatatgaaagtaaactttgaatatcttaaattattctacagatttttaaatattatattaaacatatatggagttttactaattataaatataccaactaatatatttaagagttggggcattagatatggaataattactacggtatctgcaggattttcacatccagcagaattagattttttagcaattagcattatggttatacaaacatttttaattgaagtattaaaaaagataaaaagaaatatattttcatttattttaaagttttaataataataattttaacaggacgtataaagtcaatagcattttttgtattatttgttactattgttggaatatctaattatagaaaaaaattaactaaaaaacaattgatcttacctatttttataattctttatatagcaaaagaaagaattataagcgaattattagagataaactctgtaagaggaacgttgttaactacaggtataaaaatcgcaaaagactatttccctattggaagtggttttggaacctttggaagtgatacttcaaggaaaatttattctccaatatacttcatttatgaaattaacaaaaaatatggattatcacggaaatggccagcgtatataactgattcacattgggcatcaattattggagaaaccggtgttattggaacgagcatatacatttgcatattatatttaattagtaaacaaatatttgaaaatggtaagaaatttataaataagatatctatatgtagtttgtgggtttatggattaatgtcgagcattagtgatactattttaatatcatatagaggtgtagcattaatcgtaataactaattttattatggctatagtaaataatatagagaaacttgaagaggaataaattatgaatattaaaaaaaattttatctataatgttctatatcagattttaattatgattcttccattaataacaacgccgtatatagcacgagttattggagcaaacggagtaggggtacaatcatacacctactccgtagtaaattattttgttctatttgctatgcttggagtaaataattatggaaataggagtattgcagcggtaagagatgataaagaaaaacttagcaaaacattttggagtatttacggacttcaagctattttatcaataataatgttaattatatatatgttttatttaatctttattacaaatgagaataaggttattgcaggtattcaatcaatatatattttttcagcattactagatattaattggtttttctttggaattgaaaatttcaaaattacagtcacaagaaatgcttttattaaagtaatatctgcattcagtatatttatttttgtgaaaaaacaggatgacttatatatatattctttaattttagtaattggaacaataataagtcaggtcattttatggttttttataaaacaatatatattttttgtaagggtaaaaataaaagatattctagaacacttaaagcctaatttagttttatttgtgcctgtaattgcagtaagtatttataaagttatggataaaataatgattggatcattaagtacgatgactcaggttggattttatgaaaattcagaaaaaattataaatataccattgggctttattgtagcgctaggaactgtaatgcttcctaggatgtcaaatcttttgtccaatggattactggaagaaagtaaaaaatatatttcaatatctatggaatttgtaatgtttattgcaataggatcatcatttggactagctgctattgcaccaatatttgtacctatatttttaggaagggaatttacagattgtattgatgtagttgtattacttgtaataacaattttatttattgcatgggctaatgtaattagaactcagtatttaatacctaaaaaaatggataaggtttatattgtttctacagcattaggagctgtagttaattttggaataaatatatttttaataggaatttatggtgcaaaaggagcatctataggaactatttttgcagagttttcagtagcattatatcaaacgataaaggtaaaagatgatttagatataaagctgtatctaaaaaaaagtatagtttatatatttccaggattagcaatgtatttatctataaaagctataggatactattttaatagtacatctattagtgttgggataatagaaagttttgttggaggtttaatatatcttgtgattagttttgcttatatggtaaaaagtaagaataagctggctctagatataataaataaatttaaatctaaatttataatagaaaaagctgtgcgataaattattagggggagagcttttatgaataacagctatgaaaccatagtaaacatactaaagtattcaattaaaaagcaaaattatatattagataataatgttattaattggagtcagcttgtagagaaagctgatgaacatcagatttcagcattaatatattatttaattggaaaaaataatcttaaaaatgtgcccaatgatatattaaataaatggaaaaaagatataattttaagtggtattgcacaaagaaaaattacagaagcatttagaaatataattgatgatattatattaaaattgaatatagatataatagttttgaaagggatagtacttaaaaaatactatcctataaatgaacttaggacaatgagtgattttgatatattaattcacaaaaatgattttcagaagataaaggagtatcttttagaaaatcattttgtttatattgaagataatcatccagtacatgctacattttataatgaaaatggagtatgtattgaagttcattggaaacttataaataatgaaaactatatagcagatacaataaattttgaaaaatatatatgggatgaattaatagaatttgatttagatggtgtaaaagtaaagacgttaaataaagagaactttttacttcatttgtgtattcatatggcaaaacatcttagaaatagtggctttggattaaggcagttatatgatattgtgttattttgcaataaagaaaaagataatattgattggaacatatttgaaagtaaatgcagtgaatgtggagcattgaaattttctgttggattatttaaattgataaataaattgtttaatctaagtttttttgaagaagcactaagaagaaataaactagataattatgattcagaagtattatttgaagagatactctcttatgataaatataatgaggaaagaagaaatattagtataagatcagcagctaaaattaaaaaggaaaataaaaagatattatttggattctttcctaaagagaaagatttgaaaagagattttccctatgcaattaataaattcatgttaattgtagcatggtttcacagattactaaagaaattaatcgaaaaatttaaaaagatatgtataggaaaaaatttaagaatagtaataaaaagaagaaaactattattaaatcaatttgatttataaattcatgtagctattaaataacataatgttatatatagtcttaactttgaatagtatataaagtagattaagttaaaggagaggagcatggataaaaatagtaaacaaaacttaagatatttatatagagtatatggaatgaatatagaatctaatatagagataaaagaatttataaatgcagatgaatttgaagaagatgatgaaaaagtaataataaatcaatgcgaaattaaaaagaatataaaggataaaattaaaaaaggcttatttggtgggtcaactgaaaatgaaatatggtttaatattaggaacacagcagtatatcagatagttgatggaaatacaataaattttgagatatacgaaaatgcagatatggatcaggtgaaaatataccttacttgcagttgtttaggatttataatgattcaaagggaaaaacttgcaattcatggtggcgtaattattgataatgaaaaagctattgtaattacaggtgaaagaggtgctggcaaatcaacaattactacagcttttagattgagaggatttaaatttttatcagatgatgtagcagccctttcagattctgtacctataagagtgcaccatggttttccatatgaaaaattatgcattgatgctatgaaaaattttaattatgataaaagtaaataccaatcatttatgggagacacagaaataaaatatatggttcctgctattgaacatttctcgttaaaagatatacctcttggatgcataattgagttaaaatgtgaaaatgttcaagaagttcagttaatagaagttaaaggtattgagaaattgagttgtattattaagtcaatctatagaagcgaatatttagaatctatacaaggtgtatcattaaattatatgaaaaaatgtgttaatctttcaaaaaatataagatactataggataacaagaccagaaaataaattcacagttcaggagcaaattgaattaatagaaaagataataaaggaggatttaaaaaatgaataataagaaaactaaaattaatttaacattagattgtgaagttatacgaaatttagaaatagatgatactaatattgatggtgaaacagttatgatggacattgaaaatggtgagtattatgcattaaatgaagttggaacaagagtatgggaacttacgaaggaaaagataacaattaataatatcattagcatactattaaatgaatatgatgttaatgcagatcaatgtagggagtccattctgaattttatagagagattatattatgatgaccttattaaaattgcttaaaaaatttagtgaattagaatataaaaacaaaagggattttattagagcttatatatatacaggaatatttagaatatatattttgtttatgccatttaaaagattagctcaaaagatggggaaaataaaaagtgaatcaccagataaaataaatgaagaaacttttttagaggctgaaagaatatctaaaatagtatctaaggcatcaaaatatactttttggaaaagtttatgtcttgtacaggctcttacggcacaaaaattattaagtgaaaaaagaatagccactacaatatatttaggtatactaaaagatgataaaaataatatgatagcccatgcttggacaagatgcgggaactattttgttacgggtggaaaaaataatgaaatatttactgtagtagctaagttttctaataatttataaaagtactgctgaataaaatttgaatatttatatagataaaaaatttttcattattatatatgtatgctacactataagatttacgattataatatatagtataaaaaaatctgcacgataatttgtgcagattttttaatttaattcattagcaatttctaagatgctttctttgctaagctcaattaaattaccattactaagttgtaatatcctgttgcatatatttaatgcagatggtctatgggttattattatacaggttggattattaggtaatgtttttatcgattttaaaacttctatttctgtaagtgcatctaaagatgatgttgcttcatcaagtattaaaatgggcttttttcttaaaaaggcacgagctatagaaattctttgagattgtccttcagataaaccgagccccttttcaccaagaagtgtatttaatccattatctaatttgtctacaaaattaaaagcacaggatttcattagcgcatcattaatttcatcaattgatgcattaaaatttccatatctaagattttcttcgatagtcccagaaaacaaagtattcccttgtggaacgtaagatataagctgtctataatttttatttatcaagtcaggatgttcacattgagaaattataatatttccttttgttggttgtattagtgacaataaaagtcttattaacgtagttttaccttcaccagatggaccgatcaaagcaactatttccccaggattaatattcaatgttatattttttagaattacgttatttttattatattgaaaatcgatattctcaagttttatagatggatgtgtaaggttaattgtatctttggtagatggaatagattcaagtggaatattttccagttccataagtcgttctgttgcagctattgaagaaataagtgatggaagtaaagttcctaatgatgtaattggatattgtattttgctatatagttgaagcattgctgtaaatgttccataagttgaaactccattagaaatattcaaagcaccccagcagaaaatagcaaagtatgctagattagagctcaaatttactgaaaattgtgttaaggaagagagtttagtatttttaatagcaagtgaatactgttttttttgtaatgtttcaagttttgttaaattaagtttttccatacaaaatgtttttactatcattatattctgtaaagtttcctgcataaatgatttatattttatatctatttcttgagattctttatatattttttttagtcttttactcaataatttacttattacaagtaaaaatggtcctattattgttgcacatatagctatagaaggagctaaaaatataagtgtagaaaatgaagctattaaagttactagtaatgttactatagttggaattgtatttaatagcattgaacttatagtatttacatcagaggttactcgcgttagtaaacctacactatgaaatttactttcacataaccaatcactatgttgaagatgtgcatatattcttttctgtatgttttgattcaatcttgttgatgcatgtgtattaataaaagatgttattggagtaacaatcatatttaaaagcattattaatgccataatgattagccatttaattactaagttagtttttccgctaattgcacaatctataagcgactttgaaacaagtgtattataaacattaataaaagatagcatacaactaagaaatatagtagttattaggagtggtataactggttttgattgaagtaacatccatctcaatttatttaagaaatcttttgaactttttatatgaagcttttttgataaattcatatagagctcctttctatttttttgtagttatatcaatatattatatttgtccacatataaatttattaatatagaatgtacatagctgtaataaatttaataaatctatatatttttataaaaagttctaatgagaaagtgaaaatagtatatataaacataataaatattattgaggtgttatatgaaaaaagagtggaaagagccttatatagaagttttaaattttaagaatacttatggtagaggaggcggaggtcatggaggaaattataatccacatggcaatccacatatgccgggaggtttttatcctccaggacattgctggccaccacatcacaatggaggaaatggtgattttaatggtgaagtaactggttcataaataaatagtatggaggaatataatttatatgttaatagtagaaagcaaaccaaaatgtgcagaagcagaagcatatagaacattaagaactaatatacaatattcatcagtaagtaaaaagataaaaacattacttgtaacaagctctgattctaaagatggtaaatctactgtatgtagtaatttagcattaacattttcacaaaatggtcaatcggttattgtactggattgtgattttagaaagccttcaattcacaagttttttaatatatcaaattcatgtggaataacagatatactaattggaaaagaaaaattggaagatacaattaagtgctataattccaaaacagcaattcttccagcaggaaatatacccccaaacccatcagaaatattaggatcacaaagtatgataaatttattaagttttttaagtgaaaggtatgatattgtcattatagatagtccaccagttggtgtagtaactgatgcacaagtaatatctgcagcagtagatggtaccattgtagtaattaaagcagaagaaacaaaagcgaaaagagtgacagaagcagtaaacttattaaaaaaggttgatgctaacattataggtatggtattaaatgaagcacacactataaataaaaattataacgattattatgtaaattaataaataattaaggattaagtttatggtagatattcattcacatatattacccaaaattgatgatggatcaaaaaatttgagtatgacatatgaaatgctcagaaaatgttcaaaagagggagtaaaaaaaattgtggcaacaccacattattacgattgtagtagtacttatttcagaaaagttaaggcaatggtacgaatgctaaataagttatcctataaacagaatttggacattaaaatatttcatgggcaggaaatatatctgactgacaatataataaaagagtatgaaaaaaagaaaattgcaactattaatgattctaggtatatgttaatagaacttaacatgaacagattttcagataatatgctcaatatgatttatgaacttagaataagagacatagttcctattattgcacatcctgaaagatacaattttatattaagaaaatcaaatataataaatgatttgataaaagaaggatgcttgtttcaaataaattctggaagcatagaaggaaagtttggatggaaagttaaggaaagatcaaaaatattagtaagacataatgtatataattttattgggtcagatgcacataacaacaaaagaactattggaattaaaaatggtctagaaattataaacaaaataaatagtgaatctttagaaaactatagtattgattcagagaaattacttaatgatgaaataattaaatttaaaggcgaaaagttaaaaaagaaaaagtacttttttatatagaaagatttatataaagataggagaactatgagtggagctatatttggaaaaataaatttagatggacttgatgttgattctaaagaagcagaaattatgcaaaatgctttttctaattataaattggataaagtacaaactgttagtgaaaaaaatgcctttatgggttgtggattattgtatgtgacaaaagagaatgaaaatgaggttctgccatattatgataatgatcagggagtgtttattacagctgatgccattttggataatagagaggatcttataaaaaaattaactttagaatcatggaaagatataattacagatagtcagataatattaaaggcgtataaaaaatggaaatacaaatgtgtagattatcttctcggagattttgcatttgtaatatgggatgaaaataataaagaaattttttgtgttaaagattgcgttgggacaaggaccctatattataaagttaaagaaaaatcttttagctttgcaacattaattgattcaatatatgaaaatgaagagtttaatgaaagatggttaagtgatttaattgcccttccagttgtcttacatcactcagaaagtgaagaaacaatttatgaagatatatatgaggtacctccagcaacatatgtaataataaataaggatggaattaaaaagataaaatattgggatgctgtaaaagattcaaaaaagattaaatttaattctgaagatgagtatattgaagagtttaaaaatatatttaaagaggctgtaagatgtcgtcttagaactaatcataatataggaatatctatgagtggtggtatggattcaacttcagttggatgtgtaagtgctaaaattttaaaaaaagaaaatagaaatcttatttcttttacatcagtgcccatgacatcttactgtgatactagtaataattgtgaaatttcagatgaaactgaatatgtagaagaaataaaaaaaatatatgataatattgaagtgaattattgtaaaagtgaagagagagattcattaactgatatggataaaataatagatgtattagagcagccatacaaaacatatcaaaatatgttttggtgcactgaaataatgaagagggcggcagataatggatgtaaagttttattaacaggacaatttggcaattttactatatcgtatggtgatttttttactaatatgaaaacattattaaatagaaagagaattattaaattcgtaaaagaaataagaggatgtagtaaacttcataatatttctaacttttttacattaaaacaggtattaaaaatgataaaacctaatatatttaatataagacataatgaatgtgctgaaacttttaacaaatcaccattaaatacttaccttatctctaagtggaatataatagagagatttaaaaaagaaggattggcattagaagctaagaagtttaatgatatgtactatgagagaaaatttatgacaaattccagaatgtttacgcagataggtacaatagaaactaagctgtcactagctaatggattaatagaaagagatcctactaaggataagagggttatagagttctgtttcggaattaatgaagatcagtatgttaaaaatggtttggaccgatatttgattcgaagagcaatgaaaggaataataccagaaaaaacaagatgtcttcaaggtgaaaaggggcttcagggagcagactggttacaaagaataaaaaataaaaaagaatatatttgtagtatgttagataaatgtattttagatgaaaactgtaataaatatttagatatagattatataaagcaacaaagggcaatgttagaaagtaagtcaatctgtgataattctatagatataagatctgtttttatatctataaatttatatattttttttaatagaaggagggggtttaattgaaaaaatggattgaaccagaaattcaaaatttagcattaaaggatacaaagggtggtccaaagtatgatcctaaagtagatggtgatgctatatatgacgaaaactcaaataagtggtggcaagctataggaaaatcttgatgaatataaggtattatttatataaaattaaataataaattagcttaactactaagaatttaaaagaagctgctttaaaaattttattaatttttaaagcagcttttttatacatacgatactaaatttatgtaaccatatatttgaaataagaatattataagtataagaaaatttataaactattatgtgattatttatggaaagtatgtgatattacaatggataattatatttttgaaaaattgaatatatctattattaaaaagaacatgtttaatggtaatggaataaaaatagcaataattgatgagggtgtaaataatataaaagataagttagagattgcaggaggatataatttcataaataatggtaatgattattttgatgaagatggacatggaactgcaatagcttcaataattaagtctagggaatttggtattgcacaagatgcagaattatattcattaaaagtaaaattagactttactgatgattcaattaacatggtaattaaagctatagattggtgtatatcaaataaaattgacattattaatatgtcattcggatttgcaggatttataagttatgcattagaagataaatgtgaagaggcaatgaatcaaggaattgttattgtatgtgcagctggaaataataatttaagtcaaggaatagaaattccaggtaaatataatagtacaattgcaataagtggagttgctagaaataacacacgatatgaaaaatcttcatttggaaaaagtgttgacttttgctgctatagtgaagaattattaacttatgataagactggccaaataataacaactgcagggacctcctatgcagcaccatgtgttgttgggataatagcgttaataaaagaacaaaatcctttattaactcctagagaaatttatgaattattaaaagacaatgtattaaaacttgatggaagtagaaaaagcctatattatgggtatggtctgattcaagcatttttgcttccaaagtcatataaaaatgatgagactctacaattagaagatttaaggaaaaatatatattttccatacactaaaataaatgtgccattaggtaaaaagctggattctgagctcaagtttcttccttatgatgaatgtgtaaatgtaaattatacagtcactgacaacactattgcaactacagatggcgatggatttataacaggaaagaaagaagggagtacagatttaatagctataatgaacaaaagcaaagcagcaatatgttcaattaatgttgttaaagaagaaatacaagaacctgatgaagatgtgaataattctaacttatttaaccttacagaaatgaatatttacaagatgcataaaagcggatttactggaaaaggtataaaaattggacttataggatatggatgtatagaaacagatttaataaatgtaaaaaatacaataacaattgcaagtgataatagtaaagatgcaaatggatttggaacaatatatgcaagtattattagtggaaaagaaattggaattgcaccagaagctgaattatatgtagtaaaagtagcaactaaaggtggtgtaataacatggagtgctgcagaaaaagctgttaattggtgtatagataataaaatggatattattaatttaggatttgtaaattcaaccctttatgatagtatattaacaaaatgttatagtaataatataataccggttgtaaacgcttcaggaaacatttcaggagttactgtggctcaaacatcaccgtattcaataaccgtaagttatgtaactgatgaaaaaaaatttatattaaatgattctgcacgaacaccttttactggtagttttatagattgtgttgcatatggatttggaatccagtgtattaactctgaaaataagcaggttctgtacgaagaaggaaaggcacctgtagcacagtattattgtaacttagcaatgatgcaggttataggtataatagcacttattaagcaacaagacccaactataaataatgcagtaaaagttagatccttattacccaaattatgtgaacagctttatggaggaaaaaatgactatactggatatggcttaataaaagcagctttattaagtgaaataaagtaatagtgcaaacttaatcttaaaaaataatgcaaaccatgtatacatatactaggtttgcattaaatatatcagtcataaataaaatcatgcatcttagttatagtggcatcttcatcaaaaacataataataaattccattgatagattttccttcagcatcttcatcctttggaaatctttcttctattatgttaaagttatcaaatgaagttaaatctaaacacaaagagagaatttcagatgaactcagatttgtatcaactaaaggaagaagtgaatctagagcatctggatattttaatattggaagttcttttagttttttaaatacttcatctagaactattctttgtctatgacttcgttcaaaatctcctccatcagtatatcttattctcgcataagcaagagcttgagtaccatcaacagtttgaggacctgtttgtgtaatatcagaagatgatgtattgttatgagcatttaagtcatttatataattatttatatattttaattcatcttctttaatatcgatagttagtcctccaattttatctataattttaggaaaagatgcaaaattaacagagacaaactgactaatattaaggttgaagtttagattcaaagtttctaaagtcagttctggtccgccaaaagcatatgcatgattgattttatcttttttattttttgatggaatagttacataagaatcccttattattgaagatagttttattttattatgttccgtatctattgtagctattaaaatacagtcagaacgtcctacgttatcatctccagaatcaattcccaataaagctatattttttatgtacttattctgcattctgttttgtggttgaacaggatcagaattatcaacttgagaatttatatttttaggtataaccttttctttgttaatatttactgtattaaatttatgcatataattaccaaaagctgacacagtaaatataaggacgaatattgataatattgatataataatactaatttttttacatctgatatattctttttattcataattattacatccttaatatagtttacatataaagtatattcaaaatataattttatatgtatcataaaaaagtataattaatttatattatgtaaatagttatattacataaatatgtgaatataaatatattgtaaagtaaataaaaatagatgataatttattacgtagatttgagaaagcagaggtgttttcgatgagtatattaataatatatttaatattagtcattgttatattatggtttttccatggtgctcataaaaagtggtagtataatcatactgtttattgttagttagtaatcagtaggaatacataaaaattatttagcatatatattattgtaaaaatgtttattggcattttaataatattatatggaggaaattttaatggttgaaagagcagttttaaagcgtaattctaaagatcaattacgtggaaaatggggtctcgcaatagctgcatttattattagcgcaataattccgagcatcattagtattataggctctgtaattgaatcagattcaataacgacaattggtatgattattgcagttatagtagcaggtcctataagttatgggttgtgtacatttatattaaatattataagaggaaaagatgcatcaatttctgatatttttgcaggatttaatgggaaaatttttgttaaagcacttattataatgatcttaacaacaatagctgttggaattggctatattatattaattgttccaggtataattttaagtattatgtttgcacaaagttattttattttagctgataataatgacttatcagctattgattgtattaaagcaagctgtgaaatgatgaaaggaaataaaatgtatttctttattttgatgctaagctttataggatggtttatccttggagaaataacttgtggaattggactattatgggttatgccttattataatataacactagggaatttttatgatgaattaagtaataaagtatcataagtatacttaataatgggtattataaattaaaaaattaaataatgagctttcagatagggagacttatctgaaagctcttattttcttatggaataatataaaaattaatgaaaaaaataaataaagatgtaaaatatttaataaattatcaagatattataaaaagatatagccaaaattttatattggaattataatgaaatagtatactattagttaaatagtaaattcgagggggcaaaacatgaaaaagataaaaatagcactactaggattggggaatgttggtcgtggtgtttggatgattttaaattctaataaagaagaagtaatgaagcgatgcggctatgaagtcgaagtagcaaaaatccttgtaagagataagaataagccaagacctgtacaggttccagatgaaattgttacaactgattttaatgaaattttaaatgatgatgacattaaaattgtagttgaagttatgggaggaatggagccagcaagagattacatgcttaaatgtatggataataaaaaacatattgttactgcaaacaaaatgcttcttgctacaggaggagatgaactattccaaaaagctgatgaaaagggaataatgtttcaatatgaagcaagtgttgcaggtggaatccctataataaaaggaatagatgaaagtcttacagcaaataaaattgaaactttatatggtattgtaaatggtactacaaattatattttaagtaaaatggaattagaaggtgctgcttttgatgaagtattaaaagaagctcaagaaaaaggatatgccgaggcagatccaacttctgatatagaaagttatgatgctcaatataaacttgctattcttgcagcattagcatttggtactaaaattgatgtggcaaatgtttatagagaaggaataacaaaaataactgctgtagatatgaaatatgcaagtgaatttaagatggctataaagcttcttgcaatagcaaaggaagttgatggtaaagtagaacttagagttcatccaacaatgattcctaaaaaacatcctcttgctaatgtttatgattcttacaatgcagtatttatcaaaggaaatgcagttggtgatttaatgttttatggaagaggagcaggagatcttccaacaggaagtgctgtagttagtgatattgtgtcaatagtaagaagtaatgttaacagcgaaaatgaaaatccagtagttaagaataatttatggaagagagaaatcaaagccatgaatgaagtaagaagtaagtattatgtaagagctactgtagttgataagccaggtgttcttagtgaaataacaacaattcttagtaataataatgttagtttacgttctgtaattcaaaagggtgatgaagaagaaggtgtagttactatagttttaatcactcacaaaacttttgaaggacaattaatgtcatcagttgatgagataaaaaaacttagtggggttaacaatattaataacattattagaatagaagattttaaagaaaaatagaagaaattataatatagtatagccgacaatctaatgagttgaagatgattgtcggctataaaattttaattaagattggtaaggtgtatttatgaaatattttttctttgatattgatggtacattaaaaccatatggtcagaagataccacaatcagctaaagagacaataaatagattacagaaagaaggacataagatatttcttgcaacaggaagacgaaaaaatgaaattaggaaaataatgtccaatatgaatatttataatgctgtttgctcaggaggcgcaacaattattattgataataaggttgaaaaagaagaatttttttcacagtatgaacttagaaatatattatatgaatgtaaaaaatacaatgtaataatggtaagtgtaggagaaggaagatgttatacatcttataatggattaaggctaaaaccatacattttattgatgaagttgtattctagatgtaaaaaatttagggttggatctgtggaagggggatgtggagctaattatactgatataaaaactttaagtgaggaagaattcttaaatcagccgactcagaaaatcatcttttttaacagtagacatattgaaaaatagattatttaaataactatacaatttataatgaacggatatggagaacaatagaatttgattttaaagaaaagggaatagaatatatcataaaaaaatataatgtggatataaatgatattgttgtatttggtgatggaattaatgatattggtatgtttaaatatgttaaaaattcaattgctatggggaattcatgtcaagaaataaaggatatagcatcttttataactaaaaaatcaaacgaagatggtatagagtatgcatgtaagtattttggatggatttgattaaattaaaataaatttaacatatgaatgaatgttgtagttaaatatgagattaagcacttatttttcaataagtgtttttgttattttgaccataaatacgtttgaaatgggtatattaaaggctttttataattttaactccatattaacatgaatgtaaactagtattaactaagaaactatatagtaaagtatataaatagtttacatatattatgaaagtaagtgtgttttggcaaaagattaacaaaaataaaacataataaaggggaactacagcttatgatgttgaataaaagtaaatttaagcttggatttaacttgaaaaaatctataaaaaacttaggggaattcacgaaaaaattacaaagatttaataaaactgagggaaattcaaaatcaaaaatcaagttctatggaaaaattaaagattataacttaaaaaagaaattaactttaggttttggaagcattatgattgtaaacatcgtgtttatgatttttcttttagtgagcatgggagttatgtcacaaaagataaataggctttataatggtccttttgtaactaataatagtgtttgggatacacgtatatcattattaaatatagatagatacatgtatcgttccatgcttgaaagtgatcagaatagaataggaaaatttataaaacttgctgatgaggaggaaaatgttctccaggaaaaagtaactaaattaaagaattcagataatgttgatggtcaattattaaatgattttcaaataaacttagatgaagctcttaaggataggaaaaaaataagtgattctttattgagtggtgataagtatgcagcaagaataattatggacagtggatataaatctaaaatagaaaattgtgaagaatttatttctgagatgtacaatctatcacataaagatgcagagaagtttataaaagtatcaaacataagcagaaatattgcaattgttgttgctttatgtggagttatattcataatgtttatatgttttaaaataacaaagtatattacatctaaaattttagaaggaataagtcatgttacagatgtttctaataatcttgcaaatggtgttttaaaaacaagtgaagactatgattcaaatgatgaaatgggaatgatgagtagaaatttaaatgggacaatatctatattggatagttatataggggatatatcaaatgtattaaaagaattatcagaaggtaatttaaatactaaggtaaaaataaaatatagtggtgattttttagaaattgaaaattctcttaagaatataataacttcacttagctctgtcttcttaagtatcaataatgcatcatgtatagtatctagaggtgcgaaagaaatatctgtgacaggagaacttttatcagagggatcggatcatcaggctaagtccatagaagaagttgttgaaagtattatagatatatctgataagataaaggacaatacaaaaaattcaattgaggtagataagttatttgataatacaactaaaatgataaatgatgaaaatgatagaatgaatcttctactacaatcaatggataaaataaataagtcatcagaaaaaataaatgaaataattgatacaataaaaagtatagcagatgatacaaatttattggcattaaatgcagcaattgaagcagcacgtgctggagaatatggaagaggtttttcagttgttgcagacgaagtctcaaagcttgcaaaacaatctcaagatgctgtgaagagtactacaaggataattaatgattcaataaattcaatactagaaggaactggaattgtaaaagagatatcagaagacttaaatgttatttcagaagatgtaaataatgtctctaatcttgtaaaaaaaattactatgtcatctgaagaacagctatttcatataaattcaataacaggaaaaattgatgatatatcatgtgttatcgaatctaatcttgaaattgttgaaaagacaaaattatcggcaaatgaacttgcaagggaatcaggaattcttgatgaggaaataagaagatttaattttagtatggaaatgtaattaattagtattttgatataataatgaaaaaggtgacaattcgacaggtgacagtcacctgtcgtataataaagaataaaattacatattatatatttttaaggagaatgattgaagtgaatatattaaatatagcacatagaggatatagtggaaaattcgatgaaaatacaatgatagcatttaaaaaagcaatagaatatggtgcagatggaattgaaactgatatacagttatcaaaagatggagtacctataataattcatgatgaaactttagatagaacaactaatggacaaggttttgttaaagattttacatttgatgaattaaaagtttttagaactaagagtgtaggacaggtaaaagaattaaagaaggatgtagaatctaattatacattagaagaaattgaacattttaagaataatgatggagaggaaattccagcacttgaagaattattaaaacttgtagcagaatcagatctaaaacttctcaatttagaacttaaaaacagtatagttgaatatgaaggaatggaagaaaaagtcttagatatgattttaaaatatggtttaatggatagagttataatttcaacatttaatcatttaagtttagttaaagtaagaaaattagattcagaaataaagctaggtgcacttacagagacaacacttgcaaatgtaccaaggtacttaaatgatataaaagtgcagtgttatcatccttatttccctagtatactaaatgaagaatatatgaaagagattaaaagtggaggcataatggttaacccatatacaataaatactaaagatcatatgcttaaagtaattaaggcaggtgtagactgtattattactaatgaagttgaattattaaattctatacttaaataatatataaaataaaaaacttattagaaattattgacaacattttcatgtggtgatatatttaacttataaagaaatatttgtaaataataaaattataagtaaatgaaaaagtattttgattataaatttgttatttgcaaaggaacatagtaataaaaatttaataataattgaaataataaatcaatgatagagtattaagagaaatcagtgatctgtagtaatactttgtcgttgatttttttattttataaaatgacaaaaaaataacaatctcaaaatttatctgtataaaaatatttataatgttttaagggggattcagtatgcttgataatttaagaataaaattagtaacaatagcacaggaagctgaaaaatatggtttatgtaaagaaaagacaggaagtttcagtattagagatactacaacagggtatgttcttataactccatctcagataagcagaaaagaaatgagacctgaaaacatatgcattgtagatcttgaaggacaagaaatagaagttcaaaaaggtaaaaaaccaagtagtgagattttaatgcatcttgaaatctacaaagaaaacaaggaaattaaatctgtaatgtatgtacattccttatatgcgactatatttgcagttgctaataaggttatacctcctatagtatcagattcaaagcattatggtggatatatatatgttgcaccttatgaaaaagctcatacaatagagcttgcaaaaagtgtaattggacctttaagaaaaaatgatgcatgtcttcttgaaagacatggtgttgtaataacaagtaaagatataaatgaagttgtaaccaaaggaagatatgttgaagaagttgcagaaatatactataaaacaataatgttaaataaatttgaagaaccaaacagattggatatagaagaactaagatagtaaagtttttattatattgcatatggagggatttatagtatggaaaaatttattgattctaaaaaggctatgttacttataaaggacaatgatgtagttgctgtttcggggtttgctggacttgcagtaccagaaagtcttctaaaagcggtggaaaagagatatttagaaagtggaagtccaaaggatttaacacttatgtttgctgcagcacagggagatggagattgcgaagggttaaatcacttagcgcatacaggtcttgttaaaagagttataggaggccattttaatttggctccaaagcttgctaagatgatgtctaataatcttattgaaggatataattttccacagggagttatgtgtaatatatttagagatattgcaagaaaatcagagtttactttaagtaaggttggattatctacatttgttgatccaagaatagatggtgggaaagttaatttattaacaaaggaagacttagtagagttagtagagataaaagataaggaatttttattatataaacataataatattgatattgcagttataaaaggcagctattgtgatgaaaaaggaaacatatccttagacaatgaagcaacttattcagaagcttttgctatagctcaggctgtgaaaaattgtggaggaacagtaatagtacaagttgacgaaaagatatctagtgacaagatgctttgtaaaagtgtaaaaataccgaagatttatgttgattatattgtggttgtttcagaagaagaagacaagagacaagttttggggatgaaaaatactcctttaataacagcagttcattgtaataaaaatcaaacgctcaaagaggaaaaaaatgaaggctcagataaagaaaaaattaaggttaagttaaatgcaaaaaagataataggcagaagagctgctatggaattaaaaaaggggaatattgtaaatatagggataggagtacctgaagaagtttcaaaagtagctgatgaaataggtatgaatgaacatattgttttaactgtagaaccagggcctataggaggaataccacagggaggaagatattttggtgcatcaataaaacctgaatgtatattagatcaaattaatcagtttgatttttatgatggtggaggtttagatcttgcctttttaggtttggcagaatgtgataagaacggaaatataaatgttagtaaattttgtggcagacttgcaggatgtggaggattcataaatataactcaaaatgctaaaaaagtagttttttgtggaacttttacagctaaaggtttaaaagtagatatttcagatggaagactcactatagaaaatgaaggacagaacaataaatttaaaaatgatgttgaacaaattacttttagtggaaagatggctaaaaaattaggtaaggaagttatttatataactgagagagctgtatttgaattacaagaagatggacttcatcttgttgaaacagcaccaggaatagacatagaaaaagatatattaaatagaatggagtttagacctgttattgataaagatataagaattatggatgaagagatatttttataatgcaatcttataaaaattatttgatagcaacaaatttaaaagaaaaccctattgcaataaaatctgtatttactaataaatagtaaataatttttaagaatatgttttaaattttaatgatttatcataaaaattaaaattatggattcttttcaaaaaaattcaataatatgtttgacattatatattaactgtgagatactaatgatagtccaagtaaacaattacattaaggggtgtaaagtaggtattaaaattattttagaagataatccagtcatagcagcagttaaggatgaggagcaattgaaaaaagctttggattctaatgttcagattatttttgtactttggggagatttgctaaatataactaaaataagtgaagaaatttatagtcataataaagtgggtatacttcatatagatttagtagagggattaagcaataaagaagtagtactaaaatatttaaaagaacagacaaaatttcaaggtataataagtacaaaaccacaaatggtcaaatatgcaaagaatatgggattgtatgcggttcaaagagtatttttatatgatacaatatcattaaataatgctaagaagcatataatgaatgagtgtgatgcaatagaaatgcttccaggtattatgccaaaagtaattaaaacgatttcaggatattatccttcaaaaccaataatatgtggaggattaattgaaagcaaagatgaagtaatacaagcattgagttctggtgcaacatgcgtatcaactactaaagaaaagatatgggatatgtagtcgttgtcatgaaaataagaaaagttaagtgcataagagatatagagtcaggcacaaaactaaagtaacagtaattatttattgttattaggtttttacctggctctttatatatttttataaaagaggaagggtgattttatgggaatttttcttgcagaattagttgggactttattacttatacttttaggtgatggtgttgtagccaatgtagtattaaaaaaatcaaaaggtacaggagcaggttggatggtaataacaaccggatgggcttttgcagtagctgtaccagcacttatatttggtgtttatagtggagctcattttaatccagcattaacaattgcatttgcagcaataggaaaggtcgcatgggcacaagtaccagtttatttagctggacagtttgttggcgcatttataggtgcagttcttgtgtacattcaatacatggatcagtttaaggctacagaaagtaaggaagataaacttgcagtttttgctacaggacctgcagtaagaaatttaggagtcaattttattagtgaagttataggtacatttgttttagtgtttggtatacttggaataggtgaccaaaatttaactaatggtattgggacattatttgtaggatttttaatctgggtaataggtttaagtttaggtggttcaactggatatgcaattaatccagcaagagatttagggccaagaatagctcatgctttgctaccaattccaggaaaaggagattctgactggtcatactcatggattcctgttttaggaccagttgtaggaggagttcttggagcattattttatgtatttattgtataataggaatatagaaaagcttaatattatttaattagtaatatatttatagagtattagagaagggtgtgttttacatggaaaaatatataatagcattagatcaaggaacaacaagttcgagggcaataatttttgatagagatcagaatatattggatgtatgccaaaaagagttcacacaaatttatcctaagcagggatgggtagagcataatccattagaaatctggtcaagtcaatacggtgttcttcaagaagtaatggcaaaggctaatattactcaagaagaaattgctgctattggtataacaaatcaaagagaaacaacaattgtatgggataagaacactggagagccagtatataatgctatcgtatggcagtgtagaagaactgctggtatagttgaagagttaaaaaaagatgaagaatttgttgagtatgttaaagataatactggattacttttagatgcatacttctcaggtactaaaataaaatggattttggataatgttgaaggtgcaagagaaaaagcagataaaggtgaattattatttggtacagttgatacatggcttgtatggaagcttacaaatggtaaagttcatgtaaccgactacacaaatgcatctagaactatgctttataatataaaagatttaaaatgggatgaaaagatattaaataagcttaatattcctaaatcattattaccagaagttaagaattcatcagaagtttatggttatgctaatttaggaggaactggtggagtaagagttcctattgcaggtatggcaggagatcaacagtgtgctttatttggacaaacttgttttgatgaaggtagtgttaaaaacacatatggaacaggctgtttcttacttatgaatactggtgaaaaaatgattagaagtaaaaatggacttcttactacaattgcggtaggaattgatggaaaagttcagtacgctcttgaaggatctgtatttgttggaggagctgttattcaatggataagagatgaacttaaacttgttaatgatgctgctgatacagaatattttgcaaagaaagttaaagataatggaggagtatacattgttcctgcctttacaggattaggtgcacctcattgggatatgtatgctagaggtgctatctttggattgacaagaggtgctaatagaaatcatataataagagcagctcttgaagctatagcatatcaatcaagagatttaattgatgcaatgcaagaagattcaggctgtaagcttacaagcataaaagtagatggtggagcaagtagaaataatttattgatgcaattccaagcagatataacaggttctgaagttgtaagacctataattacagaaacaacagctcttggtgctgcatatcttgcaggtcttgcagtaggattctggaaatctaaggaagaaatagctaagaaatgggcagtgagtcaggagtattcacctaatcttgatgaagatgtaaaagaaaagctttatagaggctggaagaaagctgtagatagagcaaaaggttgggaagaagaataaaattaaaaaataaatataaaaatctaaaacaatggtagacaagtatacctttacatggtataatgaagacataaagagaatataaatgctgagagaatatagagtcaggcatgaaaataatggtgatatactgcaccatatttttagcctggcttttttgatgtgtaaaaggaggagacaaaatgtatgatatagcaattattggagcaggggttataggaacttcaatttttagggaattaacaaagtataatttaaaggttgtggttttagaaaaggagaaggatgtatcaatgggaactagtaaagctaattcagcaatagttcatgcaggatatgatccaaaagaaggaactttaatggcaaaatataatgttaaaggtaatgaaatgtttgaagacatgtgtaaggatcttagtgtgccatttaaaagaaatggatcacttataattgcctttgatgatgaagatatgaaaactgtaaaagaactttatgataatggtaataagattggtgtaaagggattacaaatattgaacaaagaagaagttcttgaaaaagaaccaaatttaagtagtgaaattaaaggagcattatatgcaccaactggtggaatagtaggaccttttgaatatacaattgccttagctgaaaatggtgtggcaaatggtggagaaattaaacttcaaaaagaagtatgtaacatagaaaagaatgatgaaatatttaaaataacaactacagatggtgaagttattgaatgtaaatatgtaattaatgctgctggactttatggagataaaattcataatttagtatgcgaagaaagttttaacataataccaagaagtggtgaatattttgttatggacaagagtcagggaactgtagtgaatcatactatattccaatgtccatcaaagcttggaaaaggagtacttgtaactcctacagtacatggaaatcttttagtaggacctgatgctatagatattgaagatagagaagatcttggaacaacaggtgaaggactaaatgaaataagaagaacttcattaaaaactacagataaagtgaacttcagagaaagtataagaaattttgcaggacttagagcacaaccaagtactggtgactttatagttgaagaaaatgataaggtaaaaggatttattgatgttgtaggaatgaaatcacctggactttcttcagcaccagcaatagctttaggagttgttgaaattattaaaaattcaggattagatttagttgaaaatcctaattttaatggaaaaagagaacaaattcattttatggaactctcatcaaaagaaaaagcagaacttataaagaaagatcctagatatggaagaataatatgcagatgtgaaagcataactgaaggagaaatagttgacgcaattaagagaagctttgacgttatttcattagatggtgtaaagagaagatgtagaccaggaatgggaagatgccaaggtggtttctgtggacctagagttcaggaaataatagcaagagaatgtaatgtggctcttgaagatatagtattagaaaaagatggatcttatatattaacaggaaaaacaaaatagaatttaaatataattattgtaagtttacttggactaataaattagcaatagaagggaggaagcttaatcagttaacaggtgacagataacaatttacagttaagagaaaaacagcacaactgttttaagaagatataaagatttagaaatgtattcaaagatttttatagaaggaatatgaatcaaaactgttaattgtcaactgataattattaactgaaaaaagctgttattgatatgagttatgaattaattgtagtaggtggaggaccagcaggacttgcagctgcatatgaagcatatagtaatggagtaaagaaaatactgattttagaaagagacaaggaacttggtggaattttaaatcagtgtattcataatggttttggacttcacacatttaaagaggagcttacaggacccgaatatgcacagagatttatagaaatggttgaagatactaatgttgaagtaaaacttgacacgatggtattagatatagaaaaagacaagactgtacatgcaataaatagtaaagaaggatatatggagcttaagacaaaagctataattcttgctatgggttgtagagaaagaacaagaggagcaataaatataccaggggacagaccagcaggtgtatttagtgcaggagcagcacagcgttacattaacgttgaaggatatatgccagggaaagaagtattgattttaggttcgggtgatattgggcttattatggcaagaagaatgactctcgaaggagcaaaggttaaagctgtagtagaattgtgtccgtattcaaatggattaaacagaaacatagttcaatgcttaaatgactatgatattcctttatatttatctcatacagtagttgatattgttggtaataagagattagaaaaggttgttatagcagaagttgatgcaaataagcagccaattaaaggtactgaaaagacatttgatgttgatacattattattatctgtaggattaattcctgaaaatgaactttcatataatgcaggtcttgaaccagatagaagaactaatggacttaaagttagtgaaagcatggaaacatctgtagaaggaatatttgcatgtggaaatgtagtacatgttcatgatcttgttgattttgttacagaagaatcaaaacatgcaggtgaatgtgcagctaaatatattaaaggtgagttaaacaaaaataagtatgttgaaattatcaatggaacaaatgttaattatacagttccacaaagattaaatatagatgctgtttctgataaacttactatatttatgagagtaaataatatatatcatgacaaagctcttgttgtaagatgtaaagatgaagtaatagctaaatttaagagggctcatttagcaccatcagagatggaaaaagtaattttaggcaaagtattacttgaaaaagtaactggtgatataactatatcattggaagatgcttaaaattaagcattatataatttggctgtaaaaacagttttttgattaaaaagtatattaaaaaatactgttaactgaataagtgggagtgtgaaatcatatggaaaaggaattaatttgtatatgctgtcctaaaggatgtcatttaaaagtaaatatagatgaggaaaaagtaacaggtaatggatgtaaaagagggattgagtatggaataaatgaagttactaatcctgttagggtaataactactactgcaaaagttgaaaatggagttttaccagttgttcctgtgaaaacaaaaaatcctattccaaaaggtcttaattttgagtgtatgaagcaaattaatagtgtggtattaactgcaccagtaaaattaggagatgtcataattaagaatgtactaggtacagggatagatgttgtagcatgtaggaatgtcgatggacgataaaataacatgtttgtcgtatcaaaatagaggattaaatgaatttaatcctctatttttcaatattaaataataaaagtatatggaatgtattgaaaaaataagcaatatatgatatgataaatacataatcaaagaaagagataatgaggtctcaaatttttagttaaagacctcattatctctttttcgtttcgttatataaaattaaattacttaagcccccaaaaggaatatttctataatatagtgattgctatgccattgcctgtcacaatattaataaatacaatttccacatatattattgtatttagttagaaatataaccttttataatatatggacctctgtattttgacagcttaaatacagaggcttttttttagcaacttaacttgtgaaaaaatttattattaacaaaaaattaagataaaattatcacttattatatggtatttaaaaacctattatgttataatataaaccataaaatgaatggaggagtgtttatggacacaaaaggtaatttgtttaggtttataaaaatattaatagcagcatatcttattgtaggtatactagtattctttaatggaagtcttgtattagacttaagtcttaatgcattaacaataacaggagtatttgtaatatgtacactaggatatggattttttattagaaataagaaatacatgattacagcttttgcagtagcagcggtgtatgttgcagtagcaatagtttgtagccctgtagcaaattataaggcgcatagaaatttaattggaaatattgaagaagtagatttttctagtgaaataaaatatattgatttaaatcaacttccaactatcgacaaggaacttgcaggaaaattagcagataaaaaattaggtgaaattgcaagtcttggtagtcaggttactgtaggagagcttcatcttcaaagtataaatggagaactttattatgtagcaccacttgaacattcatcattcttaaagtggcttactaatagagaaggtacagaaggatatattaaggtaagtgctacgaatcaaaatgatgttgaacttgtgactgaattaaatggagaacctgtaaatataaaatacttagattcagcatatttattcagtgatttaagacttgcatcatatttaagagatttaaaagcaggtcacacagattatacatttgaacttgatgatactggaagaccatactgggtagttacaagatatgataatgcaattggaatttcagaagcaaaggcaataggggtcttagtaatggatgcacaaactggtcaagcagaagtgtatgacatagaaaatgctcctaagtggatagatagaattcaacctaagagttttatgaatagatatataaataaatggggagaacttgtacacggagtatttaattttactgataaagataagctaacaactacaagtggaatgaacattatatataatgatgatttatgttattactatacaggtataacatctgtaggaagtgatgagtctcttgtaggattcactttaacaaatacaagaactggtgaaacaaaactttataaaacatcaggtgcaacagaaaatgcaagtatgaaatcagcagagggtaaagttcagcagtatggatatacagcaacattcccatatcttataaatatacaaaatgaaccaacttactttatgacacttaaagattcaaatggtcttgtaaaacagtatgcaatggttaatgttaaaaattataatactgtaggggttggagatacacttcaaggaactttaaataaatatcttgaaggacttactaatacaagtatttcacttgaaggtggaaataaacaagaagtaattacaggtgaagttgaaagaatcggtgttgtaattaaagatggaacaagtatttacgatatgaaactaaaagataatgataatatattccaagtttcaacagagactgcaagagatgcagcattaactacagttggtgatagtgttgaaatgaattttataaaagttggatcaagtagatatataatagtgaattcgtttataaataattctcttggaaatgtagaacagcaacaaaaagaacaagaagaaaataaagatgtcgaaattttgaatgatactaattcataagatgaaaaaaataataattaaaatttaattgtgaaatttatgttaaataaataataaaatcattgacattatgtaaaaaagtttgtactaaaattaagatatagtgtaaatgataatatttacaagcagagataaaaattaataataagctattgtattattagtttgattatgatataatgttattgttccaaaaggaaacaataatattcaaagatttaatttaattaaaaatttctccttatgagaaagtattagttgactaagtctttaaataaggaggaaatgaaaaatggaagataagactatcgtatgtaaagattgtggaaaggaatttattttcacagttggagaacaagaattctacaaagaaaaaggtttcgaaaatgaacaagtaagatgcccagattgtagaagagctagaaagcaacaaaacaatagaagataattcatattgttgtaaaggtcataagagtttaactcttatggccttgtttaatatacaaaaatatattgcacttgaactgaagatataaattattaatttaaaatataatgaatttatatctagagtatttatgctaatttatatgatcacttttaaagccttccctttttactgaatgcttttttctgttaggattatgattatgattttcctcagttattgaagtttgataattacacttttccattcttgcatatttgttatctggttgactgtcttttgccataataatgacctcctcataagatgattttcataaatatttttcactattatataaaaatattcctatgttaaaaatagaaaaaataaatataattatgatataataagtgataattatattgatagataaagaaggcgaataaaatgtcagtaaaaataataacagatagtactagttatattcctaaagaattaatagagaaatatgatataaaggtagtatctttaaatgtaataatgaataatattagttatagggaaactgaattgaaaaactcagaattctatgaaatgatggataaaagcagtgaaataccaacttcatcacaaccatcattagatgaactctctaaaaccttagagatgtgcgtaaatgaaggtaatgaagttttatgtatatttatatcatcaaaaatgagtggaactttttctagtgctcatattgtaaaaaatatgataattgaaaaatatccatctgccagaatagaaatagtggattcagctacaaattcaatgcaaatgggatacgaggtaatagaagctgcaaaatgtgcatcgaaaggtgcagaaatgaaagaaatagtagataaagtagtaaaagtgcgagataacagtagatttttatttgtaccagatactcttaaatatcttcaaaagggtggaagaataggaagagcatccgctcttttaggaggaatacttcaaatacgccccatacttactgttgaaaatggagaaacaacagtttttgacaaggtaagaacgaagaagaaagcagtggatgttattttaaataaagtaatagaagattgtagagaaaatgaagttggtggagtaatagttcatcatattaatgcagaagaagagggaatgactcttgcaaagaagcttgaagagaaccttaatatacctataagtataaaatctatagggcctgtaataggacttcatgtaggacccggatcaattggagtcgcttattttacattataatatatatgttatttttatggggctgtatcaaattgaaattttttaaattcaatttgatacagcctattcttataaacgtaaattttattcatgtatatatttccaaatattttattttgaaataacacaaataaaggataaacattattatccatattttaactatatatttaaaattacgaagcttgctgcttatgaagcagctcaccgttacgattttgaatggttttatggtacaatttattaacattataaccaaacgccattaacaaaaattcagtacgaactttaatatttccacgcataaaaaatcttctaaaaccataatcttgtttaataactccaaatgctccttcgacttgaattgatctgttcattcttaaaagtattcctttaggtgtagtgatgtttttaagtgaatttgttcttagacgcataaaatttttagccacatgtatttgtttattaccttttgctttcgtacatttactcttatattcacagccatcacagtcttcacattcatagatgctaacagtagtttcatatccagattttgtttttttcttttttgttccttttagaagcatttttttaccagatgcacaaatgtagtaatcttcatctgtgttatagtacatattttctttcttactaatatcactcttgaatttctttgtctttgacttttcataatttgcaggtttaataaaagcttcttgtttcttagattcaagatatgcataattttcttcactttcgtatcctgcgtcagcagttacggattcatatttttgatttaaattcttttctaatctatctaaaaatggtataaaagtaagctggtcagatctttcacttgaaatgtctactcctacaatatattcaccttctacccctatttggatattatatgctggttttaattgaccgtttttcatatgatcttctttcatatgcatgaaagttgcgtcatgatctgtttttgaaaaactgtttcgtccattaaaaatgctattgtattcattatatttattttgcttttcaataaattcattaagttgttcagtatatctttggaatttactttttcttttaccttttccataaacaaattcaatattattggcttcaatcataattctgatactatctaaaatataattagcatcttgaactgatattttagcattagtaataataagacataaattcaaatcatgattcatttttattaagctttcttttattttcttttgtagtctatcttcaaatttatcaatagattttttccaaacaaaagtatatcgatttgcagatgcttcgattttagttccatcaataaaaatatttttaaattgaatttcattaagttctctaagttttttcacaagttgattaaataaattttctatacaaccagctaatcgttcacgtctaaatctatctatagaattgtgtcctggtggtagttgaccttgtaaaagccatttgaaatttatatctcttttgcatgccttttcaagagcacgacttgaatatattccttccatatatccataaactataattgcaaacatagttttaggtaaaagtgctggatttctaccaatagtagagtaagttctatttaattctgaataatctaatccctccataacatcataaagcactcttactgaatcactatcagatataatattttctatatttattgggaaacctatttgatgcataggtataatattattagtgttcatattaatattatgcgcaaaaaagagaattcaaatttatgaattctctttttttatcggctagtatcaaaattgttttgatacagccccatttttatgtagtgtaatggtgaaaaatataataagaagaaaaataaaaaataaatcaaaaaataacttgttaaatagacaaattttcagcttatacgataagagaataaggtgtaagcaaaagaagaatataatttattggagtaaaatatatatgtttaacaaaaatacaaagttgataaggttttacaactgttgtaaaataaaggaaataataaatgatctatagtttaaggtttacagcaagtaaactaaagtaacagttcagattaaaataaaaaaacaaagaggagggttgagacatcatggaaactacccagaaagtatttagaagcggtttagaatttataggagaaattaaagtaaataaatctaataaagaacttatggtagaaaaaatcttatcatatagtacaactttacaaaatggaataaaaaagtataaggaagagaattttaagtttacagtattcatattatgcagtgtgttgtttataaattttccagcattttctttaccttgttgttttatagcgactttttttcttgtgagaatgttacaactcataaaatacagaagtattcatatgattgtaaataatatggctaaagatcttgcgcataaaggtgtatacaataaaggcagtgtaggagaaatgataaaagatttcaaatcaaaatatggggatgacattattgagtattacgagcttgtttatatggttaatgaatacgaagcatttgtagtaaaaatagaagaagtaataaagaatatgcataacgaaaaacaaaagggaaattggacagatgaatatgtctatggaacttgcgatgattcactatcttttaaggaaagtcataaaaaagatgatgaaaaaacttcaatagataaggataaaagtaaattaaacccggattattctcttttatataaaaatgaagatggagagataaaaaaggtaaatagggctatagaattttttgatgataaaagcagaaaagaagatgcagttgttttaaaaggtggtaataaaaaagataaaaatttaactgtatatttatataagaagaccaatgaactgcaagacaatgtattatagatgttaatatcatattaaagtccattatataaaattaaatccttagtatttactataaaattataagaattgtataataattatatttataagcttctattaactcattaagttttttaacttagaattaataggagttgtttttttttcttatttataataaaatcatatgggtgaatttaaactgagtacggtaataagtagaattttactatatattaaagtgtaattttatattaatgaagagttatgagaatagcagcaaaataaatttattacgattaatatgctgtggttaaatatattaatcagtttttggaggaaaatatgcaagatgtaatgataattggtatagctggtggaagtggttctggtaaaacaacattagctcaaaaaattaaagatgtttttgaagataaggtttctattctttgtcatgattattactataaatcaaatgataatatttcaatggaagaacgtaaaaaacttaattatgaccatcctgattcatttgatacaaatcttttaatagagcaattaaagcacttaaaagaaggagaagctatttatcatcctgtatactcttttgttgagcatacaaggctaaaagatacggtagaagttagaccaacaaaagtaataatagtagaaggaatacttatatttgaaaataaagagctgtgtgatcttatggatataaaggtttttgttgatactgatggtgatttaagaataataagaagacttcttagagatgttcaggaaagaggaagagatcttgattcagtagtaaatcagtatttaagtactgtaaaacctatgcatgaagaatttgttgaaccaagcaaaagaagagctgatatcataattccagaaggtggagcaaatgatgttgcattaggcatgcttctagaaaaaataagaaatttcataaataattagatacatattttatatattaaatctacataacttagaattttagttgaagaatcatattattggactaggtctttataatatggttctttttagtatttaatttcaaagtaatacattttgtatagagtgaattaaaaaattaatagaactttaataattaaatacattgaggatatacctttaataacttataataaaaaaagacatgtatactatatattattttgttattatggatataatgattgatatgtgagtataattaccaaaatttttaagcgtaatatgagaagggattaaagtatgaagattgactggaacacaaaatacacaactattgcaacatatacttttatagtagcaagtgctattatattattttatcttggaatatctcagattggaatgttgttaggtaaaataagcggagtaattggaattcttcaaccatttatcattggtttttcaattgcatacatattaaattttatattgagattttttgaaagaacaatatttgattttgaatttatgaaaaagttagaatttaaacgtaattctaaaagagcaataggtcttttggttacatattttgtaagctttattgttttatatttatttattaaatttgttcttccacaattaatggatagtatagtaggtcttataaatgatattcctatgtatattagcaaaacaactaaatttattgatgatttattattaaagctaaatattgaaagacagtatcttgatttaattaatgaaaattttaatagatttatagattatgtaataagatttgtaacagatcttttacctatacttggaactttattaacaagtgtagcatctaaaatatggaatatagttttaggaattataatatctatttatcttttgagcgataaagaaaaattctgtgcattaagtaaaaagataacatatgcagtatttcctaaagcagtggcagaaaaaagtatagaaattactcatagaagtaacagcacttttggaaagtttctagtaggtaaaattttagattctgtcataattggaatattaacattctttatacttacagtatctaaaatgccttatgctattttaatatctgtaatcgtaggtattacaaatataataccattctttggaccatttataggtgcaataccatcatttataataatattatttgtatcacctgttaaggctttatggttccttgttataatattagttatacaacagattgatggtaatattataggacctaaaatcttaggtgattctataggtgtatctgcattctggattttatttgcaatacttgttgcaggaaaattccttggactagtaggaatgataataggagttcctttatttgctgtagtatattcacttcttaaggaaattgttgaaggacaacttaagaaaaaaggattgcatatagaaacaaaagattatttataattaatcttttatatggactacatatgatttatatatttagaataaatcatatgtagtctttttaaaaataattggaaaattatatcatcaatgataaaatataaatatagagattattttgatacagaagaaattttcactataattagtacaagcaggagaggtaaaacatatgaaaaaatttgaagcggtcatatttgatatggatggtgtacttattgatactgaaagaatttcttttaatgcgtttaaagaagtgcttaaaggatataattatgaaatgagtgaaaagttttatcttactatgataggtagaaacttaaagagtattaaagaagttatgatgaaagagtacggaagcagatttccatttgatgagatatacaagaaaaaagtagatatagcagtagcaacaatagaacgagatggagtaatagtgaaaccaggtgttcatgaaattgttgaataccttaataatgaaaattataaaatagcagtagcaacttctacgcgaagagaaagagctcattatctactagaagaaataaaaattaaaaataaagtggattacattatatgtggtgatcaggtagaaaattcaaagccagatccagagattttcttgaaagcagcaaagggacttggaattgaacctgaaaaatgtattgtaatagaggattcagatgcaggtatactagcagcatctagggcaggaatgaatgggataaatgtacctgatatgaaaatgcctgatgataatatgaagaagcttgcacacaagatatgtagcagtttatcagatgtaaaaacatatcttgaaagtatttagacttattgaaatacgtatacttaattcttaatggaataagtatataaaagagagacaaaaggaggataaaaatgaatatagtaattttgtcattaatagaaacactgggaatatgtatggttgggcttatgttttttgttgcaattttgttcataccaacagaaggaattaaagtgaaaaaagaatttaaagttggacctgaggggttctgcataagaatagagagagtagaagaaaagaaaaaggaataaataaaataactggagtcttcaattaaaatttaatatgaagattccagttattttttaataaattattttattgataaacaactttaggttgtaataattttggattatatccattatccttaagtgcttttattattgattctttatgatcatgcccaaatgtttccattgttatatctagttccacagcactattacgatttatgcttacgaactgattgtgatctagttttataatatttccttgagcttcagcgattacttttgatacatttgtaagttcaccaggcttatctggaagaagtactgaaattgtacatatacgttctctttctattaatccgtgttgtacaagtgatgcaaaagtaataacatccatattaccaccacttattattgaaacaatctttttatctttacagtctagatgttttagtgcagcaactgtaagaaggccagaattttctgcaagcatcttatgattttcaagcatatctaagaaagctccaattaattcatgatctgggattgttattattccatctatattttccttaatatatgggaagattttagaaccaggtgttttaacagcagtaccatcagcaattgtatccactgttggaagtgtaataacttctccagcttttaaggaagcctccatacagttagcaccttcaggttctattccaataactttaatatttggattcaataattttacaagagtagatactcctgtagcaagtccaccaccgccaattggtactaagataatatctacagtaggaagttcttttattatttccatagcaatagatccttggcctgtagctacatctaaatcatcaaaaggatgaataaaagtatatcctttctcttcagccaattttaaagcatagttgcatgcttcatcataaacatctccatataatatgacttcagctccataggcttttgttctgtttactttcattaaaggtgttgtcgttggcattactattatagctttacaattgtatgctttagctgcataagcaacaccttgtgcgtggtttccagcagaagctgtaataagacctttgcttctttcttcatctgtaagagtgcttattttgtaatatgcacctctaattttatatgcacctgttttttgcatgttttcaggtttgaaatatactttgtttccagttaaatctgaaaaataatcactgtatactaattttgttggtaatattaccttttgaacaatttcataggcttgttcaaatttatctaatgtcatcatatttataaccccttttgctattgttgcttaaaacttaatagttttatgatatcattttaggaaattatgtcaaggtattatttaaacatgtaataataatataagtgtttttataagataatgtcatgaatataaagaaataatattaaatctgttaataataaaattgaaacaaattaagaagcagctgtaatttataatcagctgctatgaaggaagtgctatttttttatatctacatcttcaccttcgccagagtatttatattctactccaagtttgttcgaaaagtcatcgcttatctttaatgtatcaatatttttacttattggaggattgtttaattccatgtctttttctgaatcagttttaaattggaacttatgaaatttattatcatattttttttcatttgtcataataatacttcctttctcaaagcaaaatattattgttataatatatattgcaattataaattaaaatgtgagttaaaaaaacggagtaaagttttattgttacttgtagacagtaatatatattattattcccaataatcatatttaaattctagaatagataatttttatcaatttaaaatgataaagataaaaaaagaataaataatagtcctattggaaaggagagctgagaaaaatggaaaaagagaagagtattgaatgtccaatatgtggagaacttatggataaatatatatatgactataatagtgatccagaagaaaagagtaattacaaatgtccaaattgtggtcatagagaatgcaaattaaaaaattattagcagaatatatagtttttataaatacaaagaaaaaaacatcagtataaaagcaaggctatattatactgatgttttttgcacaacaaattatttagatagtgaatttgttttttgaatatataggaagaagaagatttgcctttgttaataaaggtcttaatgcattatataaaaatgcaactaaaattacagatacaactgcattagcaaatgttgttatagcacttaattttgctaaaactttagcaaattcttgtggttgtcctaaaacatattgtttatagaaaaatccaactataggatcagctattacattaaaagcaagtccacatacagatgctatgatgctccatttgaaaatatattttttatcattagattcacttatttttgctattttatgagctacaaatccagttataagacctatacagaattttaaaatgaaagttttaggtgctactgtgatgtaaactggatccattaaatcagcgattgtcattccaacagctccagcaagcccaccataagaacctccaagtaataatgccgctaatacacagaaggcatttcctatgtgaagtgaagttgaatctccacctggtactggtattttaatttgtaaaaaagtaaaagatacatagcaaagtgcagctagtagtgcagtttgcattaatttttttaattttatatttgtcgtttccattaaataaaacccctttgaaaatagtttatattattgcttattattagataaaaatattttttgttttatttagctaaatatattataaaaatgctttttataagcaaaaaatcaatcctgctaaaattagacaggctatattgatatagatattatagcatcaaagagataccagtcaaatgtatgggtacattattctttgttctatatgagattatcaatgaattttaaattatatgttataaagatttaagtgtaaattaatatgaagtttatgacgttatggatggatttaaaagtatgatataataaaaattatgatgtttattgtataagaatataaaaccatatgaaaaaataattatgttgaacttaagaagagggattatgagattagataaatttttggcacaatcacaaataggtacacgaaaaattgtaagacaatatgttaaagatggtttagtgaaaattaatggaataactatttttgaggctgcagttgaaattaatgaaatagaagatattattgagtataatggacaaattgctgaatataaagaaaaggtatattacatgtttaataaaccaagtggatgtattactgctagaaaagatgccgatgacaagactgtatttgattattttaaagatattaatatggagggagtatttcatgttggaagattagataaagatacagaaggattgttgcttttcacaaatgatggtgattttaataataaacttatgtctcctaaatttcatgtagataagaaatatttctttatagcattaggcagtatagatgaaaaaaacaaaaaaaatctagaaagtggagtaagcataggtgaaaatgaacctataacaaagcccgctaaaatagaaaatttgaaaaatggaacttatgaagaattaaaggataaattgaatttaaaaaaatattatcatgttaattctgaatattatatacagtcagttgtttgtggatatattacaatttcagagggacgcaggcatcaggtaaagagaatgcttaaaagtattggctgccatgttatttatcttaaaagaatgtcaattggaaatttggctcttgatgagtttttaaaaaagggagactacagaagtcttacgaaggatgaaataaagattttatattgatacattttaattataggatataggggagagttatgtatgagtaaaaaattatgtccaaagtgtggttctgaaaaaatcattcctatactttatggatatccaacaaaagaaatgtttgaagatagtgataatgatgagtgtattttaggtggttgttgtattgcttctactgaagaggcagaaaacttgctgaataaataccattgtagagaatgtggatttgagtggaagtagaaatataataagataaactaaaagccttgaattgcttaattataagaattcaaggcttttagttattttcttaaactatctttgttgtccaatcttcacaattccaagtttcagttataatatctctatagaattcaggttcatgggaaactaaaagaatagttcctttatattcttttaatgctctttttaattcatctttagcatcaacatcaagatgattagtaggttcgtctaggattagtatgttagtttcagtgtttagaatcttacataatctaacctttgcagcttctcctccagataatactctgatttgtgattctaactgttttgtagtaagaccacattttgcaagagcagctcttatttgatattgagtgtaactaggaaattcctgccatacttcttctatacaagtatttttattatcagttctatcttcttgttcaaaatatcctatgtattggtagtctccaagatgaacttcaccacttaatggctttatctttccaagtaaactttttaaaagagtagacttaccaagaccattagctccaactaaagctattttttgtcctctttccatatataaatttaatggttttgtaagaggcgagtcgtatcctataactaaatctttagtttcgaatataactttaccagcagctcttgcagttttgaagttgaattctggctttggcttttcttgagataattcaataacatccattttatctaacttcttttgtctagatttagccatgtttgcagtagcaacattagctttgtttctagccacgaaatcttcaagtctagcaatttctttttgttgcttttcgtatgcagcttctaattttttcttattttcagcataaattctttggaattcatcatagtcaccaacatatcttgtaagctttctgtcttcaacatgataaattaagttaacaactgagtttacaaatggaatatcatgtgaaattaatataaatgcattttcatatgattgtaagtatctcttaagccattctatatgttcttcatctaagtagttagtaggctcgtcaagaagtaatatatctggattttcaagaagtaatttacctaatagtatcttagttctttgtccaccagataaatcatcaacatctctatctagtcctagatctaaaagaccaagaccttttgcaacttcttcaacttttggatcaattacataaaaaccgttgttatcaagtaaatcttgaattacagcagttctatcaagcattttagttaattcatcttcagtgcagtcacccatcttctcatataaagaattcatttctgcttcaagatcgaaaagatatttaaaagctcctcttaaagcttctcttatgctttgacctttagttaatgcagcatgctgatccatatatcctactcttacattatttgaccatgttacttttccttcatctggttgaagttttccagtaactatattcataaaagtagatttcccttcaccattagctccaagaagtccaacatgttctccttttaataatctaaaagaaacatcttcaaaaatggctctgtcaccaaaaccatggttcatatctttaacaagtagtacgctcattaatttcctcctaaacaattactattatttaaagtttatttatatttttactataaacataattgacataataaaatgatttatattttaaatttagtctttattaattataatataaattttgcaataatagacataataatagtttaaatgatactaatgtgtactgtcaaagtaaatttctgaaatatttaacttaataattgctgaaaaaatatatgattatgataattacaaatattttagtaaaaaagttaatatttttttatggaataatattattaaaatagaaaatttgatcaaacaaaaatgaaaattaacacaataatatgatatattagtacttgagtataaaatactgaacatgaagaatactaaaagtgtaaaattcagcagaaaataaagtagaaggagagacgcttatgaattacattatattattggtaggatttgcgctattaataaaaggagcagatatttttgtagatggtgcatctgctttagcgaaaaaaatgggaattcctcctgtaattgtaggacttacaatagtttctataggcacaagtgctccagaactagcagtaagtttgatttctgcactaaatggaagcaataatattgcaattggaaatgttgtaggttcgaatattttcaatacattaatggttcttggagttacaactattgtgcttcctataattatacataaaaagaatgttaaaaatgattttattgttaatacagttattactattttattattcatactaacatttgatagtctatttggaaaaggatcaaatataatatcaagatttgacggactaatattattaataatatgtttggcatacatggtaatgcttgtagtaaaagctaagaaaacagatatgcctaaacctacagaagaagaattaaatgttaatgtatttattaaaatattattgattatagtaggtgcagcaggaatagttataggaggccagctagttgtaaatagtgctagtaatattgcatcttctttaggaatgagtgaaaaattagtaggattaacaattgtagcaatgggaacatcacttccagaacttgttacttctgtagtggcagcattaaaaggtgaaaatgaaatagcccttggaaatgtgttaggatcaaatatatttaatatacttcttatattaggtacttcatctgttataagtcctatagttgttgaatctggacttatagttgattttggctttttaatagctattacattgttgttatacttagtagtttttcttaataagcaaaaagaaaaaaaacttacaaaactagaaggtataataatggtagcattatatgctggatatatagtatacataataagcagaaactaattaattaaataataaaatgtctggctttaaaataatttttatagctggacattttttatttgaattattttaaataaataataaattaatgctttttggagaaactaaatacaggtaaaatatattaccaactatacagtatgaggaggtattttctatgggagacttaaaaaataagatgaaacaagaaggtcacaagatgggtgaagaaataaaagaaaaaggagaaaatataaaagacgaaatgaagtccatggctcataatgttggaagtggagtaaaagaagtaaccaatgctgtaaaacagaaagttggaacagtaacaaataacatgaaaagcgatgcacatacattaggtgaagatataaacaatacatttaataaggttaaagatgacattaaggacacttatgataatagaaaagataactttaaataaatagcctatttatgaacaattaaaaataataaatttataatattttttaaaatgatttgaatatatattatactatgttcaaatcattttactttgtaaaaaaatatttaattatataataatagtaaaatatggtataatttaaggggtagtataaaattatgttaaaaactatggtaataaataattttaaagagctttatgtataagaggtgtataaattgataattttaatgattataagcataatgacactattgatatttttattaatttatctctattttagaatacgaaaaagatttattgaaatggaaaagcaaatggataatttaagaaggtctaatgatgcttttaataataaatttaaaaatatagattatgaaatagactctattgatgaagaaatcaataatatcaataccataaatgaagaaataactaaagaatataaaagtaatgaattattattccgtaaaaagtctttttttaagatggttgataggacaattgaaaaatacgttaaaaaatatatttataaatatatttatgaatatgtaaaaaaagagggttctatcaaaatagatgaggatgaaaacaatagagataataatagtattggtttgccagagaagagtacccttttaaatattgatgaagcatttttgctaggggtagagaatcttaaggataaaaagaaggttgaatgccagttcttgttatcggaagttacagaaaattcatatgaaaataataaaggtgaaggtgaaaaaaattataataaaacaatgatgcagttttttgagtggtattatcctaatgatggttcattatggacaaaggttaaaaaagaatgcgaacacttaaaagatattggaataacatctttgtggcttccaccagcatataaagctcataatggtataaatgatgctgggtattctgcatatgatttatatgatctaggggaatttgatcaaaaaggaacaataagaacaaaatacggtaataaagatgaatatgtagaatgtattaaagaagcgcacaaaaatggaatagagatttatggtgatgttgtattcaatcataaagcaggagcagatgatacagagcttgttgatgcacgtcaggttgatgaaaataatagaaatatatttattggtgaagaaaagcagataaaagctcatactgttttttcttttccaggtagaaaagaaaaatactctgcatataaatggacagcaactgattttgatggagttgattatgatgatatatctaaacaatctggaatatttaagtttaagggaaaagaatgggaaaaagacgttgatgaagaaaaaggaaattatgattttttaatgtttgcagatctagatatggatagtccttatgttatagaagaactgaaaagatggggaatatggtacatgaatgaaactcatgtggatggattcagactagatgcaataaagcacattagatttgacttttttaatgaatggttgaaagaaatgaggcagaatagcagtaaagaactttttgctgtgggagaatattggacttgggatgttgggagattaaattattatcttcacaagtgcgattattccatgagtttgtttgatgcacctcttcattataattttcattcggctagtaattctctagggcattatgatatgagtaaaataaaagaaaatacattacttaaatcaaaccctgaatatactgttacttttgttgataatcatgatactcaattaggacaatctcttgaatcgtgggtgagtccttggtttaaaccattggcatatacatttattttgacaagaaaagaaggatatccttgcatattttatggtgattattatggaattcctgataaaggatatgatggaataaaagaaattttggatattattcttaaagtaagaaaaacatatgcatatggtattgaacatgactatattaatgaaaaatctattataggatggacaagagaaggtgattgtgaacataaaaattcaggtcttgctgcattaataacagttgcattaggtggaagtaaaaaaatgtatgtaggtatcaatcatgcaggagaaacatggaatgatgtgacaggaaataattctcaagaggtagttatagggaaaaatggagttggggagttttatgttcaaaacggttcacattctatatgggtaaaaaagatttaagtataaattataaaaaagtggtgaaactcatgaaaaatacaggatcagataaaaggaaagtattctcaaaattaaaaaatactagggagaaattatgcataatacttggggttgttttactattgtatataattttaataaatacaataagcagttctaaaatcgcattttctaagcctatttgtttttttgctgtagttattatagcggttggatttatgtatgataaaatatatgcatttatacaaagtaaaagtattttaaaaaaattagtaaagataataaaaatatgtatagcattaattatagcagttttaattgtaatagaaggtgttataattgtttatccaaaacacaatatttcaaaatcagattatattttaatacttggagcaggattaagcaatggttcggaacctagtttaacattatctggtaggcttgatgcagcaatagagtatataaaagactataataatcattcaaagatagtagtaagtgggggcaaagggaatgatgaaaaaatatcagaagctgaagctatgaaaaaatatcttgtaagtaaaggaatgccagaaggacaaatactaatggaaaataaatcaacaacaacttacgaaaattttaaattttcaaaagagctgatagaagaagatagtaataaagaaattgatgaaattaatgtgaaggtagtaacaacagattttcatgcttttagaagtaagcttcttgcacagaagaatggatataataatgtaacaaattattcaagtgaaactgtgtggtatctgattccagtaatgtatttgagagaaggatttgcagttgtaaaaagtcttgtattcgactaaaatgtaaaaataaagaaaatatatacctgtatataaaaatgattttatattttttaaagaattatattgaattttaggtgaatttttagtataaaataataatggaattaattaaacaatactgtttctttttttacggtattgtttaattttagttagaaagattaataataaaaaatttaggctaattaataataaattgaagtgtgatattaacagagaggttatatgaaatgagaataaataaactttttagtaatcttggaatatgttcaagaaaagaaacaaataaattaattgaacaaaaaagaataaaaataaatggagagtactgtgttttaggacaatgggtagaagataatgatgaaattttatttgatggtgaacgcgttaaatctatggaaaaagtttatttagcattttataaaccaaaaggcattacatgcacattagaaaaaaatgcccaaggaaatataggagaatatataaattataatcaatatgtttttccagtaggaagattagataaggattcagaaggtcttattattcttactaatgatggagtattttcaaatcatattttagaatgtgacaataaacatgaaaaagaatacatagtcaaggttgataaagctttcgatgacaactttctattgtctatgagaaccggtgtcgaaatttcagctaaatctgggagtggtgtaaaaagaatatcagattcagaagggattgtaattaaagatggaaaagatgaaattataatgcttgatgaggctaaaaatggaaaaatgaaaaaagacattgttaaaacaagaccgtgcaaagtagagaggataaatgaagatacatttaaaattatattaactcaggggttaaataggcagattagaaagatgagtagtgtacttggatataaggtgatatctctaaaaagaataagaattatgaatattcatcttgattatttagaatgtggggaatatagattaatacctaaagagcatattgacgaactaatgaaaacgaattataaaaatacttaaaatttttacttaaaattcaggaggaaaatgactttaatgaaagagttacataagataatagaatacaaatttattgataaggaatcaaagctatatgattcagcaatagatttaaggtatagagagttttatgaaacatcaaatagggctaaggaagctatatttgatgagtttgaagataaaagtatgagaattgttgcgtatatagaggaaaaggtaataggccatgctcgtttatttgttcatgattcaataggcgaaatcactcaggttgtagtagatcatgagtatagaggaatgaaaattggagttggaataatgaacaagctaattgaaaaggctaaagaaattaaagtccaacatataacccttgatgcacgtgtttatgcagtagaattttataaaagatttggatttgaaacaaaaggacaagaatatacatcattaaagacaggtatgccaataattaaaatggttcaaaattttacatatgaaaattaaaagaagtgttaagctttatgcttatgcttctttttttattcaacctatgttttttaaaataataaatagaatttgattcattgcaaaaatgagtttatggataccgtgattttgtggtttagtaaaatagccaaataataaaatcccagactaatgtttgggattttattattggtcatcatctaatttaggatttaacaatgaaattacagcagttgctgacaataaatatgatgcatttaaaagtaatgaaggtgaggcagaatcaattattgatctttgtatttcttttaaagcattttcagcttcatataaagtgaatttttgttttttttgatggtctatagttttatttaataatgttgattttatgttgttaatattaacgaattgttgattttgtgatttttcttcgtttgtacttatgttaagtgtaatttgtacgcttttagttaattgtttaaaagaagatgaaagaagaaggaagtcatatggatcttgtgtgtttatagagtgattttgtaggttattattgtattcaggtaatgtattatagtcttttgatattggttttatttgtttttttgcaatgtttgctgttatgttattttgtatattttgttctagtttatatttttcatcagtgaaattaggaataattcttgtagaatttgaagatgctatagattctacaggcttaataataagattatgtagtctgtaaataggaattctcataaaaatctctccttttaaatagatactaatatatttatatctattcacaaaaggagagatttataattaaatagtcaaatgaaattaaagtttaataaaattattaatgtacttcaatgtgcttatgataccatgtggtgaataaaactttaaatgaagccgcaagtggtactgcaataagcattccaagaagacctcctacattcccaccaataagtattgccatcattgtgaaaacaggatgaagtccaacactatttccaacaatttgaggagcaagcaattgattatcaatttgctgaacaataagcatagctattattgcatataatatttttataggatttccgcttaaaagtcccatgacagcagcaagaacagttcctacaattggtcctacataaggaatcatatttgaaatacctgcaatagtacctattacaaatgaatatttaatacctgcaatgcttaaagcgattgaagataaaacaccaacaaagaatgcttcaagaagctggccacgtatgaacttaccaaatacttcgtgtattatgctaaatatataattcagtttatttccagcagaaccgcctctgaaaatcaagtagtataattttttccatatgcttataaagtattctgaatctttaagaagataaatacttataataaaagcaatgaagaaagtagcaatgctactaccaatggatacaagtgatgatgtcatgttgcttaagtttttcataacataagtttgaattaaattaaagccatcaacaatgtaaggctgaagagcacttataattggtgaattgaaactttctattgtttctttgatagaagaagcagaaaatgggttattatcaaagtaaagattaatatcagatataatattggcaattgtagtattgcttgaaagctggcctccaatcataaaatatattccccagattaatgctgtaagaatagccaatacactcacataagaaagaattacggcagtaattcttcttgtaccaaatttttgaatttttaatattttattattctcaagaaagttttcaattagttttgtaattggataaagtatgtatgcaattacaatggcaagtaataaaggtttcagtaggcttatgattgaaaaaattactgataaaacatttcctaaaatattttttatattaaaaagcagtaaaaatactatgtatatggctatagctgtaatacttatgtaaactgcatatttaaaaagtttcttatcaaattcaatcttcattatttcatctccttttctagttttaaatacaattataatttatattgatatattaataaagatgaatataaaaaaattacaccataatgtaaagaaaacatgtattggtgtaatttgagatttagattgtataagtttaaaattttacttataagcttctaaagtctttagataattaatctgaagctgatttttattaatgtactttaatgcatctggttctgttctttttaaacctgaaagtatctcattgtgtattgtctcaaagtcatcataacttaattcaacaaagtaatcacaattgtcacatacaagacaattagactttttataaggaattattggaatggttaatattgaaaaccaatgagtgacaatgcatagttcccaataagatttctttttacatgatggacaatctttttcgcttacggtgccgataactttttttgttatagtatctttgcttaataaaaacataaaaatacctccccgcatgtatataaatatttcattattttttattattaactttattgtatatataaatacataaaaattacaatttcaatacaaaatgtataaaaaaggtgttaacgtgtggaacttatctgttaacgtgtggaggtcttatgattggaaaattataaaaaagttaattattaatagatgttataatttaatatgagataaattatagtgtgaatttcaccagagaatatacaatataaaatctatgaaataaatgaaggagtaagggaaaatgagtaatgcaaaaatctttaatataaatgagataattacaattgtgatggaggaagttaggattaaagaaaatagacagatgtatggtatggatgaagaaagtgagttgcctaaaggtatatgtaataaactagattctttgaaagaaattgaatttaaagagttcttgagtagaattgaacaaatcgcaaatgaaatattacatataaaaagtggggaattaaatgaattgaacaaatgtcatgaagaaattatttatatggcacatgagaaattagatgattatattatcagctaaaaaatgtatgaagtttaattaaagtatataaatatagtttattatattaacgtaaagaacattataaggtttaatttaatataataaaaaaacattagttttagagggtaaaatggataaatgcaattttaattcatttgaagatataatgaaagcatgtggatattcttttgatgaagagggaaatattgactggtgcagctttgatgaagatagttatataggatgtaaggatatgacgggtggctttcaaagtgtttaccctcagctttttgttttggtaggtgaggttataggcgccataatttcagaaaaacttcctattaatgtgcagaatgcctttggaaactggcttcagcttattggacaggtaattttaacatataatgcacaacagcaatattttcaaggaggtcccggaagatattttaatcctaaatattataatgtaagcaattcattttgtactgatacagattatgtacaggatggagaagttaaaagtgatcacaaaaaaagttcaaaagataaagcaaaggtcaaaaatcttgaaaaagaaataagatatttaaagagtcaaataaatgaaatgaaaagggatcttgataatataaaaaaaggagaataagtaggctttgggaatgctttctaaagtctatttgatttgtttgtggtacatttaatgtttattataaatataatgaataaaaagtgtttttgaggttcatatgaattatgatgaaattaacgaatttttaaaaaagtatagtgatgcaattttttcagaaaataatactaatgatgataataataaaaattcacaaaaagaagattctaaaagcaactgcaagaataattttaattatggatttttttacacaaatgaaaatggatatggatgtaatgatatgccaggtggatttcagaaaataaatcctatgttatttgttgtcataggtgacattttaggtgatttgatgtcaggaaaacttccatttaatgttcagaatgcagtaggaaactggatacaactagtaggacaggctattgaaacttattctggacagcaacagtattttcaaagtggtccaggacgctattatagtcctgaaaatttaaatgttactaatccattatgtccaacaagttcatccaatcagactacatcaactagcaatacaaacagcaattctcaaaatgaaacgagtagtgataatgaaaagttaattgaaagcctatattgtattataaaagacatgaaagatgaattagatgatgtgaaatcaagggtaaagacaattgaaagacaggaaagataaattacgcatattatagaataaattaaatataatatattataaggctaagacatgaaaaaacatatgcttagaccaaaaaattaattgctagacatacacctacctaataatcaaagaacgtattctacttatatatagtcagaatacgttctttggttattacatagagttattttgttttccaaaaagttttgcttttactttttttagatttgtaatctgcttagttatggtagaaacaaatattacaccaagggctagacttcctgcatttgcaattgttgtaagaccaagttcaatggcacctgaaatatttccagttattgtttcgtacattgtatagtacattccagcacctggaacaagaggaatgagtgcacatactacaattgttgtaacaggtgtttttaaaattcttgcgcatatttcggaataaatactaaatattactgaagatagaaagaaggcaagaacatcactaatgttgaatctgctaaaaaataaataacagagccaacttaatcctccacctagagctgcaaataataggtttttccctcttatgttaaaaattattccaaatcctaaagatgcaataaaagatacaaatgtttgaataatcattattgtcattgtcctccgaataaaaattataataacttatgattgaattgtatttaagaataagcttaaaatagcaccagtacctacagcaattgatatggcaactaaaaatgcctcagcagcttttgtgattcctgacaataaatcaccagcaatagtatcacgaatagcatttgttattgttagtcctggtacaagaagcataatggaacctataattgttttatcaaggttagcacaaatatttaatttcatgagtattatagctagtattgcacacaaccctccaccaagtgaattgatgaaaaaactatttatatctaatttttggcaaatggtggaaactatcttaatacaagctcctattataaaagcagcaaaaaaatcttttatgttgccaccaaacataagtgcaaaacaacctgcagcagcacaagatgaaaataatgtaagtgcagctgaatatctgtcactttgagaaatattaataagctcagtattcaactcatcaatagtcattgattgagcctgaacctgtctagaaagattatttatcaaatctattttgtttaaatctacacctctacttgtaattcttctgacaagagtaacagttgtagaatcttttgttaaggatgtaattattcctgtaggagtgacaaagctttcagcatcatcaacaccaaaagataaacctattcttactatagtttcttcaactctataggtttctgcaccactctcaagcattattttcccagctaaagttgaaatatttagcaatttatttaaattcatgattaattcctcacattttttttatcaaatgaattatagcataaataatttattgattatagggagattgttttaaaatttttcataaaacttttgaaaaattaaaaaaaatatacatctttaatattataaataagaaattttaaagtaaacataaaaaaatgttgataaatatactcagaaataatataatctgtatatagttaagaataaatatggatattcttttattagttttgttattataaaagaatataatttattacttatatagttaatatgttggggtgattgcaaaatgaattttgaaaacattaaaagagaagacaaagaaatctatgatctaattgaaaaagaattagacagacaaagaaaaggaatagaattaatagcttcagaaaatgtcgttagtgaagctgtaatggaagctatgggatcgtatttaactaataaatatgctgaaggttatccaggaaaaagatactatggtggatgtcatgtagtagatgaaatagaacaaatagcaattgatagagcaaaacaattatttggagcagaacatgcaaatgtacaacctcattcaggttctcaagctaatatggctgtatactttacagtattagaaccaggtgatacagttttaggaatggacttaagtcatggtggacatttaactcatggttctccagttaatttctcaggaaagttatttaaatttgtttcttatggcgtagacaaagaaactgaaatgatagattatgaaaatgtaagacaaattgctttagaatgtaaaccaaaattaattgttgcaggagcaagcgcatactctagaacaattgattttgctaaattcagagaaatagcagatgaagttggagcgtacttaatggtagatatggctcatattgctggattagttgcagcaggggttcatccatctccagttccatattgtgattttgtaacaactacaactcataagactttaagaggtccaagaggtggattaatcctttgtaaagaaaaatatgctaaggacttaaacaaaaacatattcccaggaattcaaggtggtccattagaacatattattgctgcaaaagctgtatgttttaaggaagcattagatcctaaatttaaagaatatgctgaaaatgtagttgagaattgtattgaacttgcagaacaattaataaagagagactttaagattgtttctggaggaacagataaccatgtattcttagttgatttaaataataaggatattacaggaaaagaagcagaacaattattagattcagtaggaataactgcaaacaagaatacagtaccaaatgaaacaagaagtccatttgttacatctggaataagaattggtactgcagcaataactacaagaggatttgttaaggaagatatggctgaaatcgcagctattatggatgaagcgattgcaaatagagagggagatttatcaggtcttaaagcaagagttgaagctttatgtgataaacatcctttatactaaaataaataataaagggctatctaatttttgatagtcctttatttttatttatattctataactgcgcatgataaacaattcaagtgtgaatattaaataaagagaaaattttaatttaaggaggattcttatatatttgtatataagagaagaaacaaatgaatgaatttagaaatattaatgttaatgagctagaagatataatggataaaattaatttgattgatattcgagaaaaagatgaatatgagttaaaaagtcttaaatacactaagaacataccgatgcatgaattattggagaattatgatgattatttgaatacagatgaagaatactatttaatttgtgaaactggaagaaggagttttattacagcagctgagttagcggatgcaggatatagagttataaatgtatccggaggaacaagtggatatttgggagaaaaactcaattaaaatatataaaaataaaatggtacctgttttattgggtaccattttacttgtttgtatgtaggaattatttaatactgaaattcagtcacttggttataacaagaatagcttcaagaaaaattgttaaataaaaagtactttaataattattattaaactttgatagaagtatataatataaatattactacttatgattattactcatagtaatatgaaataaagaataaaatttaattctttatttgtatttcgtttaggagagatagagaattattcagtaattagtattatcaaaatactaattattattcgtttttaattatgtatattatgaatatttaaaatataatacacatatatctatataaagtttattatgtagtacttgtatttttattgtcaataagtatattaataatatgaatttgttttattagtatatttattattgacttttaagtgaaaatatatttataatgttactttatatgtgtagccaaatcattaaatttgtgttataaaagtattgtagaattaaatatatctagggtttgttagagggatttgagtgaaaagtaaattatgatggggaattgggttgtcaggtatagttgtatctttagctagtaagttaagtttttataaagaagctgatgttgagtttcaatttatagatactgctagcctaagaaaatatgcgaacagaggtaatgctagagctcaaaatatactaggagataggtattttaatggagatacagttgatactgattataaggaagctgtaaaatggtataaaaaagcagctttttctggttatgatgtagctatgtataatttgggtgatatgtattattgtggactcggagtggcgcaggattactgcaaaactattgagtggtacaaaaaagcagccagcaaggggaattgtaatgcacagtgtaatctaggatgtatgtatgaagaaggtcaaggtatagaatgtgattataaagaagcactaaaatggtatacagaagctgctattcaaggagattattttgcacaatataatcttgcaggaatgtatatgcattctaaaggtgttgaagaagactgcgaagaagcttttatatggtatgaaaagagcgctaagcagggatatgaaaaagcacagaatacaattggatatatgtatgaaaaagggttaggcgtaaaacgtgattataaagaagctataaaatggtacaaagaagctgcagaatttgggtacccttatgctgaatacaatcttgcaggaatgtattataagggtaaaggtgtacagagaaatttaagcagtgcgtatagttggtataaaagatctgccgcacatggacttgaaattgctaaatgtgcgttaaaagaaaaatttaataaataaataacataagcttaaagtgaattatataattctttaagcttatgtttttatatggaattataatctagtctataaataagaaatttatttctattgtcttttaggtattctggaaaaacaggcacttctttgtagagagaaaaacatgtgttattttcaagataaaaaatataatcatcagaaggataatataaaataatatcaacaatacgcatattttcatctactgagtcaagaatgttgtttacaactttcataaaaatttgaagtgaaaatggattgaaaaaatagaacttattatcacaaatttttatgttatattcttgagcaagacattttataaattgaattttgttgtagtcattagatttattatcatttaaataagtttttttattatcagtacaaatttcataataataattattcatttcaattccagtaacataagaattgaagaaatgattaagataaaagttaagacgtccttttccacatccaaaatctataatgctgtcatcctcattaaaggaatattctttggtcaatgtatggagtgaattataagaagttgcttcatatctatggtaatgaagtgaatcattaaatatcttttgttcaccggtagtttttatacttagtaattgttcataatattgttcgttcataatagctcctttcaatggaaaggataaaatataaattaattattgtcaatatatataattagaaagttaggtattatataattgaatatttaaaaaatacaggagtaaactaatgataaaatattttcaatcaaaaacatttaagatggccttatcagctactatagcaattttgatagctaattacatgaaacttaactttggtgtaacagcaggaataattgctatattaagtattcaagacacaaaaagagaagctcttttaataagcttaaaacgaatagcagcatgttttatagcaataattttttcttttgttttatatgttgttcttggaagtaatccaataatatttggattatttttaataatgtatataccaataactattaagtttaaaatacaagaaagtatggttgttggagcagttttatcaacacatcttttaactaattccaatataaattattactggattgtaaatgaggtagcacttgcaataatcggtgtatgtgttgctatgttatttaatttatatacaccagacttagaggaagaatttgaagttaatagagaaagaatagagcagcagtatagaactattttaagtgatatggctggaagcttaattgttagggaatttccaagtgatgaaaaagaaatttttgaaattacagaaaaacttatagagaataatagaaaaatagctaaaaatattttaaataattacttaattttaaaaaatgattattattatttaagctatatggaaatgagagctagtcaatttgaaacaataaagagaatgaaaaaacatttttcaagattttatatgacgtattctcaaactgaattattatcagattatacatataaggttgcatttaatattcataaagataataattgtgtggaacttatcaatgaacttaatattttaagaaatgaatataaaaaaatggacctccctaagaatagagaagaatttgaaaatagagcattactatttcaatttctaaatgatttagaagattttctgctactaaaaaaagcatttaaagataactactaattaattttgataaatgaataaagtaaagctaaaaattctatatccggttaattgaaagttctaggtggagatttcaacactaaatataagatgttcacaaatagtacttacagggagaattaagttggaatatgtatagtgtttttctcagaaggagaggataaaaaatggagggattaaaagaattaatcaataataatattgaaattgtatttattctaataataatatatgtgattggatttattaacaaaataataaggaatattataaaagaaaaaaataataagaagagatagtataagaggattacttttgtggtaatcctcttaagcattataatttagaagtgtggatctatttcattttgctgaattctttttaaatcttttaatcttaaatttgtagcttccattatggaatcaaaagactctccttcaataatcattttttttgctaaatcatgggattgtttactttttactttattcataataaatcacatctttcgtataaaaatatttaatcataattattatgtgattaagtacgaaatttatacttaaggtaaactaatataaataattatattattatagtataatatttatattaataaaataattttagagcaatgagtgacaagggggaaattttttgaatattattgaagaagcaaaaaatataagcagtaaaatcattgaagatagaagggaattacataagattccagaaacaggaatgatacttccaaaaacagctcaatatgttataaatagattgaaaaaattaaatattgattttaaaacatatgatagccactcaggaatttgtgcagtaataggtaaaaaagagggaaaaacaatagctgtgaggggagatatggatgcccttcctgtaaaagaagaaacaaatcttgaatttaaatcggaaaatgggaatatgcatgcatgtggacatgatgcgcatactgctattttattgggacttgcagaactattaaaaaatcatgagcatgaactaaacggaaaggttaaattgatttttcaaccatgtgaagagtgtggtcctggaggagcaatggctatgattgaagacaatgttttagaaaatccaaaagttgatgctatgcttgctctacatactgataatgctataagagattatgaaaatggtgatgttatagtaagatatggaagtatgtctgcatatgaagatcctataaatttaaagataatagggaaaggtggacatgcatctacacctcatgtttgcatagacccaatatcaatagctacattgataattaataatatacaatatatattaacaagagaaatagatcaaacaatacctacacttataagttttacaagtattcaaggaggtaggggatctaataatattattccagatgttgtggaagttaaaggaacactaagaagtactgattcaaaagtaagagagtatgtactagacagaatagtagaaatagttgatggacttacaaaaataatgaaagctaagtatgagattaactttttaggtggatgctcaggagttgttaataacagagacatggtagataagtttattacttctgctgaaaaaattataggaaaggaatctattcatgtattaaatgattataatatgggagcagaagatgctggtttcttttttgagaaagttccaggatgttattttttactttataatcctcttccttttgatgatggagttatatatccagcacataattctaaatttatgatggatgattctgttttatataaaggagcagctctatttatgcagactgttatagattacttgggataataaggttagaatgttgaaaatatggcttaaaatcgtcatcataacattaattgataattatttacacgaaaataatataatgatataatgaacttgtcatattatattaaagaaatttaacaattattatctttacataatataaaatatttataaatgcggtatattatagagggggaaaaaaatgagtaacgaattagacaacaatgtaaatataaaagacgaggttaagaatattacaaaaaacttagttgaatctctttcgcaaatttcagcaggtattaatgaagttgctgttggggtacaacagttagcagaaatgaatacacaacttcttagagaaacaaatgaagctaataagaaggctaaaaatagtgatgaaatagttggaattatacaagatatatcaaagcagacaactcttttaggattaaatgcttcgattgaggctgcaagagctggtgattcaggtaaaggttttgctgttgttgctcaggaaataagaaagctttctaatacatctaaagaatcaattaataaaattgatacaattataaagtatatttctaattctatttcaagtattgatgacagcttaaatagtacaaatgaaatatctcaaaatcaatcagctgcattacagcagataacagcatctgttgaagaactaaattcaacagcacatttattaggaacaattgcagacaaactttagcatttttgagaatggacatatggtttacatatatcatatgtctattttcttatgcaagtaaaaatataaaaaaaatatatgttatgatttattattaataagtaacatatgtatattcaaaaatagggggtttttttatgaagaaaaagataatagcatcactattagtttctttatcagttgttggaatactaccagtatctgcacaagctgcatggaagaaagatgcatataataataatgtatgggtagaagcaggtggcatcaaacaaggatggaattttattgataatttctggtattatctaggtgcagatggagttccagtaactggatggttgcaagataaaggcgactggtactatatgtggtcaaatggtactatggcatataatacatggatgacaaatggaggcttatggtattattttgatgaaaatggtaagatggtaactgatttagtaaaagtagaaagtagagaatatgattttactaatactgcaattatattatctaaaaatataggactagataatacaaaaaacattccacagacagctgagaaagcagtttcagatactgatgtgtcatcagttgtaagcggtgaaggaaaataaaattttagaagaatttataggtagattaagtataaacttagtctgcctttttaatactaaaagtatagaaaaatttataagaggctgtgatatagttgaaagtgatgacttttaatttgcgatgtgattttcctttagatattaataatcgttggaaaaatagaagacatattacttataatataatagataaatataaatgcgatattataggaactcaggaagctactgaaaatatgtataaggatataaagaagaattccgataattataatataataggtaccccaagaagtagaaaattttttgtggaaagaaatgatattttaataaaaaaagaaaataagattattgaatcaaaaacattttggttgtccgatacaccagatacagtgggcagttcaaaatggttttccgtatttccaaggatttgtacaacggctgtaattgagttaagtaataaagtgaaaataagagtatgcaattctcatttagattgttttacatcaaaagcaagagaatatgaattaaaaaggcttatggaattaatagaagaagagcagataaaagaagatcttccaataataattatgggtgactttaattctggacctgatagtaaacttataaaaaatttatcttctggagtttatggaagcaagaaagtaagtgcagtacaggaatatgataaacgattgtatatgaattcaactatgagtatgtttaaggggaaagaaaaaggacttcatatagattatatttttgtatcagaagaatttaaagtcaataatgttgaaattgtgagatataatgaaaatggaaaatatccatctgatcattatccactaatggcagatatagaattaatttaaaaaacatatatatattgcaattgacaattgacagttgagaattgacaattaagctgaaaatccttacaggattttttgaaattatatgcagaataattactgcaacatatatattaaattttatatataaagatttttagaaagttgagaataagcatgtaatatactgtttattctcaagtaaattatatttttagtcatattattgtgacaaaagtaaggacgtggtttattgtcgaaaatagaatacatgttatattttttatatatatgtatagctatagttttaggggttacaggtgcttattatgtggtaacaatggaggaaattaatattgcatcatcaaaaaataaaattgaagaaaatcagccccaagatgaatttaagaaatatggacaagttataaaagttgattccaacttgtgtataagagaagatgcagatattaatagtgaagttaattatgttttatatgaaggaatgacttttgacatattagataagaaaaatgaatggtattatatacgatataatgatatttttggttatgtaaatgaagattatgttgcagaatatgaagatattcctcctaatgaaacatatgaagaaagagaacaaaatatagtaaacaatcttttaaagaaagtacataagcctataagtgttgaacttactgcatattgtaactgtagtatatgttcagaagcttggggatcaaaaactgctatgcagacacaaacaagaaaaggtgttgttgcagccccaaaagaaataccacttggaagcagattatacataccacaacttgagtattataaagaggactgcatttttgatgttgaagacagaggtggggcagtaagattaaaagatgatggcacatacataatagatatatggcttccagatcacgaacaagtaaaagagtttggaagaaataagggagtaatttatttaattgaaaattaaagtttgattttttgagtccactttccactaaagtatctgtaattgcttattaacaactcaatactccatcctatgggtattgagtaccatatagctttttgacctattaaagatgaaagactgtatgcagcaaatactcttattccaaaatttgataaagtacttaataagaaaaatttcatatctccacagccctttaaaattccatttgcagtactgctaataccttttaatgtatatcctaatgaaacagttcttaaatattcaattccagtagcgattacaagaaaatttgcagaagaatctacaaacatatctattaaatttttcccatagacaaaaagaataatagtgatggatatagaaaaaattaaggttaactttaaagctgctttgtaaccttcttttattctgtctataagttttgcaccagcattttgagctgtaaatgtggaaactgcattgctaagattaattataggcataacagcaagagaatcaatttttgttgcagcagtatatcctgaaacaatatctgctccgtatgaattaacaagtgcctgaactaaaattaatcctaatgagacagtggattgttgaagcattgtaggaatagcaattttatttatttttttcaatatatttatatcaatatgaagacttatcttattgtttatttcttgattaaaacctattttgatttttttctttagaaatattatggataatatagcagaaacaagctgagcagtaaaagtagcaaaagcaattcctaaaattccaagctgtataattgtaacaaaaaataaatctaaagctatgtttagtacagaagaaaatataagtaaatataatggagtttttgaatctccaagagcattaaaaacagaagtagtaccattatataaaaacataggaagaagacctaaaaagtaaacttttaaatataaattagcatcggaaaaaatattataaggagtcttcaaaagccttaaaagcatatgagaagaaaatacgccacaaatagttaataatatacttaaaaatattaaggatattagagaagtataaattgaattcttcatttctatataatttttactgccaaacatttgagaaataacaacacttgaacctatgctaagtccactggcgatagatataaagagaaaagttattgggtaagatactccaacagcagcaagtgaattagaacctaaaaaatttcctataattatagagtcagaaatattgtataactgttgaaaaatatttcccattaccattggaagtgcaaaagtaattaatattttatttggattaccaaaagtcatattttttgccattataaaaatatgcagaataaaatgtgaattctgcataacctcctctcgttattaaaaatagaacttatgtagatttataattgtaatatagatagatatattatttgttttatgaagtaaaaatataaataattatatatgtataaaaacaaaaaaataaggaataactatcactttttttagtgtttttcaagaaaaatttttgtataaaccgctataaatttattgaataaatggaaaaaaatatattaaaaaagtttgtcctaacacatatgatttagtatgtaaaaaaaatatgtacataatttgaaaatacttcttttgaaaagaaaaaatatataacttataatgtgttcatgccatatcggtgaggaatagatagcagcttaaaaaattagcataaataatttaaatgctgatgcagttatcaaaaagtaacaaggagtggttttttgaataaattaagaaaatatatctatagaggatgtgcagtgctctgcctaggtacagttattattggtggagattatgtttataaacataacagtacttttgaatatcatgaagaattattatattctaataaaacaaatgatattgtagcagatgattatagtaagtatgaaaaaaaaggaactgtggttaatgtagaaagcatattaaatgtaagaagagaaccttctgtagatagtccaataggtaatacattggataatggagaaactattaatattgttgatgaaaaagaaggatggtatgaaatagaaggaaatgataacgttgtcggatatgttaaatctgattatgttgaagagcataatcaagagtatcagccagtaacattagatgttaaaaccgatatgaaagaagagcaaacttcacaagcgccggtacaagatttaactaatacttctcaatcagaagcagaaaatagtacacaaaatcaagttaatgttgaaactgtttcagtagaggaaaagtctgcagaaacaccaaagggaaagaagattaatgttgagcttactgcatactgtaatgatgagaagtgttctggaaaatgggggggaaaacagcccttggaacagaaacaagagtaggagttgttgcagcaccatctagtatttcattaggtagtaaattgtatataccagaactttcatattataaagctgattcagtttttgatgtggaagatagaggtggagcagtgaaaacaaaagaagatgggacatatatagtagacgtatggtttccgacccatgagcaggttgaaaagttcggtagaattaaggctaccgcatatatattagaatagttacattgctataagaatattcagggctagatatttatatatctggccttgaatatttttactatgttttcagcttttatgaataaaaagtctgtgatttataaaaaataaattatactctattattcaggaggtgaaaaattgctaaagtataattagactttagcaaaatatgcatgaaaaaatatataaaatatctttattgtggaattataagcattatgcttttgtttatttattccataaatatattagcagaatcggatgctcaaacaaaagaatttatgaataatcattcggaaatattaaagtcaataaaagaatgtactgaatgtataaataagaaaggtgatataagaattgattttttagaagaagttattcattataatgagattcaaatatgcatgtcagaaaattttataaaatgtggagatgataagaacgtaagaaatatggcaaaagctttaataaagaatgcaatggaatgtactacagaacttagtgaaattttaaacagtataaaccaaaagccatcaattaataaagaattagaagaagaatacataaatgaatatgctgaatcatatgaaaagatgattaaaaatcttgagtgtaaaagagatgatgatataggaaaaatttttttaaagtcatctattaagcagcatgaatctttaattgaactgacagaaatctttattaagtatagtgatgatgaaaaaatcatagaaacagctaaaggtattagagaaaagaactataaggaaataaaaaaaataaaaagtgtattaaggaaagtttagggcaatttatagtaaaagatctattaaaactaaagcatatgtgttatgagtctgttttaataggtcttttaagtactaatatatagtatttatggataagatattaatatttaaaaatattgtgatagtattttggagagatgaaaagtgagggatttggaatttactaaaaatgaaaaggcagagttaatatatgatgttgtggcaggaataatggcggtaattgctgtattaattgtcatgatggatttttcaagttcttttacagaaagagaattatattatatacatataatagataatattgtttacttttcatttgtagcagattattttataaggatgattctttcaaaaaataaaaagaagttctttttacataatataattgatcttattgcaatatttccattaggattttttgcttctgtcaaatatggaagtgttctaaaacttataagagttgttacatatttattaaggttgattggtgatataaaagaagttgtatttacaaataattttatctatgctcttggaattacaattcttattactattgcgggatcaataggaatgtatttttttgaagtcaataataatggtggaattaataattatggtgatgcactgtggtggagtatagtaacagtttcaacagttggatatggagatatatcagttgtcacaagaggtggaaggattgttgcctgtattcttatgataacaggagttggttttttaagtatgcttacaagtacaatgtcaactttcttttttaataggcatactaaaagattaataaataataattcagagaatacacaaaattcaattcttgatatatccaacttatccgaagaaaataaaaaaaatattataagttattataattatctatgttttaaggaggaatataaaccctaatagcagtatacatttttttatgtctatattatactatattagtagattagagtagaataagggatatagtacatgacatattgaaaggtggtgaatttggtaaggaatctaaaaatttatctaatttctatcctctgtagtgttctaacacaataggtaaaatagactatgttaaacgtaaatttaagtaatgtctgtttttatttaagtgagagaaaaatagcaagacgctaaaaaagtgttttgtgaggatataagtttaactaggatttcttactaaagattacttatgaaaaaaccagaacttttagctccagcaggaaacttggagaaacttaaaacggcaataacatttggtgcagatgctgtatacttaggaggaagcaagttaaaccttagagcttttgcagataattttacaaatgaacagttaaaagagggagtagagtatgctcatgcaagaggaagaaaggtttatgttacattaaacataatacctcatgatagtgatattgcaggaatagaagattacttaagagaactttatgaattaaaagttgatgcagttcttgttgcagatccgggtcttatgacaatagtaaaaaatacagtcccagatttagaaatacatttaagcactcaggcaaactgcttaaattatgaagctgcaaaattttggcatagagcaggtgtcagtagagtagttacagcacgtgaaatgacttatgatgaattaaaagaattaagaagagaacttccagatacatgtgaaatagaagcatttgttcatggagcaatgtgtatgggcttttcgggaaaatgtatgctttctaattatttaacaggtagagattcaaatagaggggcatgtgcacagccatgtagatataaatatcatctttacgaagaagatgagaatggtgaaatgcatgagatttctaataatatagatatattagacgaaaatactaatttttgtactgatccttcacagaaaattaaagttgtagatgatgaaagcaaaattgaaatagaacctcatggagttcatttaatgaactcaaaggatttatgtatgatagaacatattccagaacttatggagtgtggaatagattcattaaaaattgaaggaagaatgaagagtgtttattatgttgcatccgtagtaaaagcttacagacaagcaattgataaatatatgagtgatccggaaaattataagtatgatccagaatggatggattatcttttaaaaccaagtcatagaccatttacaacaggattttattttgatgacgaagttaagcaaacctatggaagtgctacatatatacaaagctatgatattgttggagttgtaatagaatatgattctgaaaataaaatagcaacaataaatcaaaaaaataaagttttaaatggtgtagacgtagaagttttagagactgaaggagaaaatagaattataaacttaaaagatatgagaagaaaatctgatggggaaagtatagagagtgctaacgtacctcaaatgatttttacgattcagtgcgatgaagaacttaaaataggtgatattctaataaaaagtaagaaataattttataagtatgtgattgaagcagggggatttttaaaattttcctgctttttaagtaataataattatatttatattataatttttgtttaaataaataggattaattataaaataggaaaaaaggtgatatattatgggaaaaagtgaattaatgcttgatgatgttatggagattttaaataaccaaaagaagttttttgatacgaataaaactaaagatataaattttagaataaattcattgaaaagtcttaaaaaagtaataaaaaatatgaaaatgagattattaaagcattaaataatgatcttgggaaacatgaatttgagtcttatacaacggaagttggatttatttacagcagtatagatgactttataaaaaatataaaaaaatggtctagacctaagaaagtaaagactccaatatttttacaaccagctaagagtattataataaatgaaccttatggaacagttttaataataggaccttttaattatccatttcagcttataattgaaccgcttataggagcgctggcagctggaaatactgcagtagttaaaccttcagaaatgtgtcctaatgtatctatgatacttatgaaaattataaatgaagcgtttgacccagaatatgttgcttgtgttgaaggagctgtagaaacatcatcaaatcttcttaagagccactttgattatatattttttactggaagtgagaggattggaaaaattgttatggagaatgcagccaaaaatcttattccagtaacattagaacttggcgggaaaagtccggtaatagtagataagacagcaaatatagataatgcggctaaaaggattatttggggtaaaactgttaataatggtcagacatgcgtagctccagattatgtacttgttcataatgatgtaataaatgaatttataaaaaaagcaaaacaaacaataaaggagttttatggagaggatattttaaacaataaagattatggaagaataataaatgaaaatcattttaatagactaaaaaatataatagacaaagaaaaggaaaatataatttttggagggaattataataaaaaagatatgtttatagaaccaacattaattgttaaaaatgcttttactggagaaagtatgtcccaggaaatatttggacctatattacccattattggttatgataatattgatgaagctataaaacaaattaaaggtttatctaaaccacttgctttatatttatttacagaagatgttaagatagaaaaacatattttaaatgaaatttcttcaggtggtgtatgtatcaatgatactataacacatcttgcaaattctaatcttccatttggaggtgttggaagttctggaatgggatcataccatggagaagaaagctacagtacattttcccataaaagaagtatattgaagaaaagtagtaaaattagttttactatgctttttccaccatataataaaagtaatttaaaattagtaaaaaaatttttaaagtaaaataattgtaagggaaacatataaactcgtaagaattaagtaaatataataatattgttcctttctgattatactataactgttattttaaaatgaagactcattttttaggctacattgaaaggagcagataatatggaaagaacacattatatggtagatggactcgctaatgaaaatatgaagacacaggttaaaaatgcattagaaaaaatagatggagtaaataatgtatgtgtcgacttggctagaggaagtgttgaagttatttataatagccctgcaactccattagaaataaaacaatgtattgaaaatacaggtcatcctgttcattaaaataaaaataaaattccttcaaattattgagggaattttatttcttttaactatcttttattttatgtaaatgtcttattaaccttcaattattttcacataaaaagttctgtttctaggaccatcaaattcacagaagtaaatatcttgccacattcctaaaacaagtttacctttattaagaattaatgtctgagatgcacctatacatgaagattttaaatgagcatgagaattaccttcaaaatgtttataattagaatctattgaaggataagctttctcatatccataaataagatcgtctactacatctggatctgcattttcattaattgtaattccagcagtggtgtggggacaatatacaattactattccatcttgtattttgcttaatgaaatatcatcatttatatacgatgttatatcaataagtgtttgctttttattaattatcaatgaatgttcaaagaaattagtcataataggcagaacctccttatattaagttagaaatattatactataacgaatttatcaaatctatttttaaattacaatataatagttaataaggaaaaaagtaaaaataataaaggaaatttaatgtagatatagaataagtattaagtaacttataaagtaaggggggagaaatttaaatgataacagaagcaaataaaggaataggattttcaagagtatttgctacagttttttgtagtttatttattatgcttgggagtctatgcttaagctatcaaacagtttatgcacaaacaagcaaagatgatgaaagtaaaatagcagcttcttctgaaagcagttatgttttaactttaattgaacgaggaaacattaaagaaaaaataacaggatcagatataaatttaaaaactattaatgaacaatctaaagaagtttcttttgattataatttattaaataatgttattaacaatctttcatgttttgatgaaaataatataattgaatcaaagaatgcaaagctagaatatgtagggaaccgatatataataagaaaagagatttatggaactgaaattgataaaaatattttatatcaaaatattgtaagcgcaataaagaatggacaaaaaacaattaatttaaattctataaattgttataaggatcctgtatatacttctacttcacaagcagttataaatgcacagaatactcttaatagatatgtttcttcaaagatatcatataactatggtacagatggtagtgttcttgatggaaacactataaaggattggatatacattaatggtgaatttcagataacaattcttgaaggaaaagtaagagaatatgttgattcaatagctgataattacagctcatctttaggatacacaatacctgtttcaggtggtagcagtggaaataatcatagctggagtgttgatagagtagcagaaacttctgcattaattgaaaatataaaaaatggacaaaatataacaaaaaatcctgctttcgttcagaattcatatgcaagctattataagactttaggaaatacatttgttgaagttgatatgggaagacaatatttatggttctataaaaatggatatgtagttgctgaaggagatatagtaacaggtaatatgagtcttgaaggttgcccaactccaacaggagtatatacattaaactcacgtcagaaagatacagttttaatagggcctgattatcaatcaccagtatcattctggatgcctttcattggtaatagcattggacttcatgatgcaagttggagatggaattttggtggagatatatacaagaataatggttcacatggttgcataaaccttccatattcccttgcacagactatttacaataatataagcgtaggaacgcctgtaatttgtttttattaaagaaaagagtacacttgaaaatacgagtgtactcttttttgatgcatagaaaatcttatattttctaccgaaattgttaattgttcattattaattgtaaactaaaaaagtgacactgatatatatgtgagataaggttagaacttctttaatagtccacacaatactagaaataatattgcaattaaaaatgaagcgtatataaaaatacttgaatattttccaataaattttgttgtttgctcaccgtaagtataattcatgggaagagaattaacattcccattcttatcaaataacatcttaactgttttatcctttgctaaataggaatcttctagtggaattatttctaaattagtgcagtccatgtgacatttcttacaatacaatcttattctatcttcaatttctggattcatattaaggtatcaactctttctatggaatattttgtaattataaaaacattataacattaaatagatatcatttataaccgtatattcattaatatagtaaattaatttattaataagtatatattgcttaaaaattaattaatataggatgaaaataataaagtgttaaattatatcatgtaaacgtgatataaatacaacatatatagtttaaaattgacaaatagataactgagtgataatattgttatgtcattataaggaagtgtgattaattgtaggaagtataagataattaatcacacaatatttattaaatattgggggcgaaaagatgaatggtttattaatgattggactagctatgattgttttaggtggagcctatataatatatggaagatggctagccaatacatgggggattgacccaaaagcaaagacaccagcatatacaaaagaagatggtgaagattttataccaacacctaaagggtagtgttttcacatcaattttcatcaatagcaggtgcaggtcctgtaactggaccaatacttgcagcagtatttggatgggtaccggtattattatggatattaattggaggaatttttttcggggcagtacatgattttggtgcactatatgcatctgtaaaaaatgaaggaaaatccataggagctattattgaaaaatatataggtaaagctggaagaaaattattcttcttgtttgcatggattttttcacttttagttattgcagcatttgcagatatggtagctaatacattcaatggatttaatgcagatggaacacaaaatgcaccaaatgcagcagcagcatcgatatcaatgttatttatagttgtggcaatggtattcgggctctttatcaagtataagaagcctagtcaaggccttcaatttggaattggagttatacttttaattgctatgcttgcagcaggaattgcatgtcctatatttttaggtaaaggtgcatggcttgcaatagtttttgtatatcttttcttagcagcaattatgccaatgtggcttttaatgcagccaagagattatttaagtacattcttattaataggtatgattgttggagccgtacttggaattgtagttgcaaatccagcaatgaatcttcctgccttttcaggatttgaagtaaatggaagtatgttatttccaacattatttgtaaccatagcatgcggtgctgtttcaggatttcatagtttagtttcatcagaaacatcttcaaaacaggttaagaatgaaaaagatatgcttccaataggttttggggctatgcttatagaatcactattaggagtaatcgcattagttgttgttggttatgcagcaaaaggtggagttatgcctaagggaactccgttttcgatttttgcaggaaatgtagcagggtttttagggttacttggaataccagaacatgttgcaacttgcataatgacaatgtgcgtttcagcattagcactaacatcattagattcagttgcaagaataggacgtatgtcttttcaagaattttttatgactgatacattagataatgataaagaaatgtctggatttacaaagattatgactaataaatacttttcaactatattcactctttcagttggagcattattatcactaggtggttataacaatgtttggcctttatttggagctgcaaatcagttgttatcagcattagtccttattgcacttgcggttttcttaaaaacaacaaacagaaaaggatttatgctttggggaccgatgataatgatgttatgtgtaacatttacagcattagttcaagcattgataaaaatatttaaaaaattatttgtaactggtgaatttgcatttcttactgatgggttgcaattactatttgcaatattgctaatagttcttgggtttatggttgctgtgtcatgtttcaaaaaactattgggaaaagatactattcaagatattgaaactaatccacaggcataataaatagtacttttaagaatttatttaaaaatatgataaatttaaattgagaaatagaaattaattagtagaattggacattttaaaaagacaagccattttgtattattcaatagggcttgtctttttataaattaactttctttgctaattagtttgtcattatgaagaatatgaccagtaagccattgattaagtaattcaagcaattctagaatatatttatcaggatcactatctatagttttataatctacttcatttatttttttaatgaaggcatcatgctctattttttgagtaaaacgtcttttatagttgatgctgtccatatattcttcttctgcattaaagtgaaaaacagtataatcctttaattcatccactaagtctatgactttatcatatttgtctattgtaaaatcattttttagaagagtatatgcttcatttgctatttcaaataatcttgcatgttgctcatcaataaaatcaattccagttttaaattcatttttcatttcatacatattaaaaacctccatttaataattactaacaaaactattatacactaatcattgaaattttttcataatacttttaaactaattatgtaatactattaattagtgaaattaaatattatgagtagacgtaatatttataagaaaggaagcgatattatggagttaaattggagcttaaaagaaatatatgaaggttttgaaagtaatgaattcactacagatttagaaactttggataggattataaaggatataaatgtatgggtggactttttaccaagagataaagaacaccaggttgaaaatttagaaaactatataaaaaaatttacaatatttaatgatttaagagataagttatctatgtttataaatcttaagctcagtgttaatactcaagataagattggactaaaatacagtgatattttggaacataaattaactggtatagttgaaagtaatacaaaaatagaaagatatataagttccattaaagatatagatgaatgtataaatcaatctgtatatttaaaggaacatgagtatatattgaaagaaattataaaaacaagctcttatttattaagtgagaaggaagaaaatataatagctagtatgagaaatactggatcaaatgcttggattaaattaaaagataacttaatatccaaccttatggttgaaatacaagaagataatgaagttagaaaacttccattaacagttgtattaaatatggcttatgataaagatgaaaacattagaaaaatggcatacgaggctgaaattaattcttataagaagattgaagaaggtgtttgtgcatctttaaatggtattaaaggtgaagttcttactgtatgcagactaaaaaatttcaaatctccattagaagaaagtcttttaaaatctaggatgaatgaaaacacattagaagtaatgcttgaagcaatgaaagaaagtttccctgtttttagaaaatatctaaagagaaaagctgaaattcttggacataaaaatggcttgcctttttatgatttatatgcaccagtatgtgaatgtaatatggagtacacatatgatgaagctgtaaaatttgttgagaaaaacttcagaacatttagtgataagttaggagattatgtattaaaggctgtaaataacaactggatagatgtaatgcctaaagaaggcaaggttggaggtgctttttgtgaaaatcttcaatttataggtgaaagcagatttttattaaactttggaggaagtttcagtgatgttgttacattagctcatgaacttggtcatggttttcatggtgaatgtttaaaaaatgaaacaacaatgaattcatattatccaatgcctattgcagaaacagcatccacattttgtgaaacaataataaaaagagcagctttaaaaaatgcagataaaaaacaagcacttgcaatactagaagcagaaataagtgattgtacacaagtaattgtagatatatactcaagattcatttttgaaagtaagttttttgagaaaagggaagaaagtgcattaagtgtagatgaaattaaagagcttatgataaatgcacaaaaagaatcatatggagatggtcttgatagggattatctacatccatatatgtggacttggaaaccacattattatgatccagaatataattattataattttccttatgcatttggtttactttttgctaggggattgtatgaaaaatacaaaaatgataaagaaaattttgtagatgattatgaaaaacttctaagtattactggaaaaaataatttagaagatataacaaaaactatgggaatagacataacaaaaaaagaattttggaaatcttcattaaaaacaattgaagatgatattgagttatttatagaattgagtaaaaaatagtttttaagaaagaggaataaatgataggaatacaagaaatagacataaacattttaaattacattcaagaaaatattagaaatccattattggataaaattatgccttttataacttcctttgggaatatggcacttttgtggattattatcggtatggtgttattttctattaaaaaacatagaaaatatggatatatggtgtttttagctctactattatgctttttaataggaaaccttgcattaaagccattagtagcaagaataagaccttttgatgcatatcctttaattaatggactgcttataaatgcacctaaggatttttcatttccatcaggacatacaatgtgctcatttgcaccatctgtagttttgttttattttaacaagaagattggagtttgtgcattggttataagtgtattaattgcactttcaagattatatctttatgtacattatccatcggatgttttatgtggaatgataattggtgtaataaatggaattatagcgataaatgtaattaataagttttaccataaaatgtaaaagtgtgatattatattatagtgacagtcaaaagggaaaaagagaaatagggtataacaatagggtttgaggagatgaaaagtatggtcagcttaaaatatccagcaatatatactgatagtattggatgtgagaaatgtactgtttatttatgtgataaaaattttcagttgaaagttagaggatttgatttttatagtgatcagtatgattttgatttttattgtgaagatataaatgaaacaaaaaagcatttctatttaaaagataatgaacttatagactatgttttagatataagaataaaagtacccataatttataacaatactgaatatatagaaaaagctatattgcgaattgagagacagaaaaattattataataacagacttataattgataaaaaaaatacagcagaatgtatagcaacgggggttaattttaaaaatataatatataatctaaaaagtattcttcctaacgaatatgaaataaaaacagatacgagacaattattagctatataataattattatttattaatatgagtgagttatagaaaaatatttaaaattattatataatattactaaagattaagtataggagggagaattatgttttataatgtagccgatattgtagataaaactataaaaatagaagaaaaaagaatagttatgattaatgatttaatagatgagaatagaaatctcccgactataaatttattaggaaaagtttttcgaaaagaaagttttaagatgatatcttactataaagatattaaaagagagattagtaattgtgaagttgaagaaatagactttagaacatatgataaaatatcttttttaataactgaattttataatagtatgtttataccgaatactaaaacaccaaaagaatatcttaaacatgcattaaatattgcagtagatgaacttgcattgttcattgatattcaaggaagaatcgtaaataattctagaaatacttataaaataacatatgaggttttatcaaaaataatattaagattagaaaaacaggttgaaaatattgataaactgttaaaaaattaatttgtttaatcaaaaacaaaaaaactattgtaaaattacgttattaactttaaaatataaatagagttactaacgcaaaggagcgtatcaataatttgtgattatttgatatgctctttttcattggtattaagaatatatcaaaaagaagtagaggggataatatggataaaatagattataagattatagagcttcttcaggaaaatgcaagatatccattaaagcatcttgcagaagaggtctttttatcaacgccagcagtttcagcacgtatagaaaagttagaggaagcaggagttattacaggctattctgcgcatttagatccgttaaaactaggttataatataaaggcttttattaatttggaaatgtctccgaaacagaaagttgaattttatccatttatagcatcatgtccaaatgttttagaatgtaattgtgtaactggaaagtattctatgcttattaaagttgcatatcatacaactcttgaacttgatgcatttataggagagttgcagaaatttggaaacactgaaacacaaattgtgttttctactgctgttgaacatagggggataagccttaaggctgagtatagcgataattaattgtaactataaaatgttacaaatattaatttaatatgaaaggataatcaataaatattgtatataagaataatgaataagataaagaatatcataaaatatcttataggtttgttagaaatagatatagtaagagtagtatttttttcaataattacgataatattattaatggcttttgtacataggatagtatcataaatgtttttataagatagaaataaagtaataaaacagaaacttgtctcataaacttatattagtaaagtattgactaatggtctgcttaaagtgattctacgaattagattattatgtcagattaataataaggaggagatattgtgactgagtatgaagaaaagcttaatgaaaataagaacataatactgaggaacattcagcaggggaagcaggcaggcgtaaataaggtttcagctgtctttgcagtaagtaagcgagatgaattaagaaagaatatggttacagatctagctatatggctaatatctaatggatataaagtgtctttaaaggacggggaactggaaatactaactatagaatgggaatgattttagcagaattaacatattagtactaaaatgtttgttgtagttattgtatatcttacataaacttagaagatatactattaatcttgttgaagaataattaagggcaattttatgtgaatgcataaaattgccctttgaattttactagaaattaataaaatgcaaggaaaatatatactgtattattgagaaattaaaattattagcatatactataaaaaagattaagctattaaaatttaaattaactgtggtatagggaggaatagtatatggatgaaagatatgatatagctattattggaagtggtccggcaggtctttcagcagcgctgaatgcaaaaataagaaaaaagaaatttgttatttttggaaatgatgaattaagtggaaaattggtaaaagctcaaaagataaacaactatttagggttttatggaatgagtggagctgaaataaaagaacagttcgatagccatatcaaatcaatggatattaaaattaccaatgaaagaataaacaatatatattcaatgggtgattattttgcattaatggcaaatgataagacatatgaagcattaacagtaattcttgcaacaggggttaattttggaaagccatttgaaggagaagaaagacttcttggaaaaggggtaggatactgtgcaacgtgtgatgcacctttatataaaaataaagtagtaactattattgcatataataaaaaggaagaaagtgaagcaaattttgtggcttctattgcttctaaagtttattatattcctatgtataatgaaaatattgaattagatcctaagatagaggttattaaaggtataccaataaaaatagaagggcaaaataaagtagaaaaattaatccttaaagatagagaaattgaaacagaaggtttatttatattaagagagagtgtatcaccagggcagcttgttccaggtttaaaagtaacagaaaatcatgttgaagttgataggtttatgaaaacaaatttaaatggatgttttgcagctggagatatagttggaatgccatatcaatatattaaagcagctggagaaggaaatattgcagcactttcggctgtatcatatttagataaatttaatagaaaatagaattattatataataaagaaaattgtgcgtgatattgaatatagttatgcacaattttctttttatatacattaatatttagaatgggttaagggaaaattaaattttataacagaagatgtaatatattaagttatattagataaataagggttattatgctaatatagaattaatagtacataatattatttgtggagattagtatgaaaaaagataattatattttaagtgtaatagatgaaataacagaagtattacaaaaaaatgaatatgtaagagaaagatattataatgacgttgcatggcttaaggaaaaagcaaaatttataaagaaaaatattgtacgtatagctattatgggaataacaagcagtggaaaatcaactttagttaatgcacttcttcaagaaaagctgcttccagtagcaattaagccaagttcaagcataattatcacatgttcaaaaggaagtttaaggcaggctacagtatattttaatgataaaaatcctatggttttaaaagataatgaactaaatgaagaaaatataggaagatattgtgatgaaagcaaaaatcctaataatgaacttcaggtagcacaaatagacataacaactcccttatttatgcttgatgaaaatatacatattatagatagtcctggtcttgatgcgtgtgatttagaaattcatgaaaaagtgactatggagatacttcttcctacaattgatatatgcttatttttaacaactgtaaaagccaatagtgatgaaataaattcggagaaaatgagaatagtaaatagaagaggcaagcaaataattcttgttcagaatatgattgattcagttgaagagaaaatagggaagaatggaattgtagaagagagtaaacttgatatattaaaaaaacataaaaaaagaggagaaaatcttttaaaatcagcaatttatcaatgtaattccaatgatagagtaagtactaaagaaaaaaataatatagcagcagaaaattttgaagtagtgcagatttctgctttgaatgctttaaaaggtatcattaataaagatgaggaaatttatagaaagtctaattttaatgaatttatacatggaattgaaaagtgtgtgagtaaactagcgcctaaaataaatagggaaagaggcataagtctcataagtaaaattgaaagtataataaaaactgatagagaaataatagacgaaaaaatggaaaaataaatgaaagttcagatattgtaactaaaaaagatattgatgatgctttcagaaattttaaaaaattaaaagaagaagttactttaaaaatagaaagtgttgatgggattttatatgaatgtataaatgacataaaaaactcaaaagaatataacttaaaagcatatgagaaaataataaacagaattaatagagaaaaggaacttattgaagaagaaattcttttaacagtaaaagcatgtgaatataagaaaaatattttatataaaaagcttaatatggatgtcatatatagttatgctctgccaagtatggattatgaaagtgtaaaagttatgcataagtataaagaaaaaactgaaatgataaagaaacagggtgtatttaacaaaggcaaaagaatattctctaatgtttttgataaaagttggggatatgaagaaaaagtacttgatgagaaaattatagataaatcagctacaataaaaaaactagaaaatgtatgtgatgttaacagagtaaaatatgtaagtatattaagagaatggactaaacaatacactagatcaattaatgttttttataatgaagttagcaaacgtgaaaaagaattaactgataaaaagaaccaagatatagaaatatataaaataaaacagatatttaatgacctagaaaaaataagaaatgaacttatactaagaaaaaatcctacaaatgaggagcttgaattagcagcaacattaaatgaaacgaaatctttgaatacattaaataataatgagagttttaaaacagtaagcgctattatagataaaagtagttataatgtttataaaataataaatgatatatgtgaaaaaaattatagattcattggtagatatatgaatgatttatcaaacaatattttaaaaaataatagcactgatttattctggacatgggatgaagagacagcggtaagattcattgcaagaataagtggaatatatttatcaaatgaacagattaatgaattaaaagaatttggtatatttaagtacaaaaatataaatgttgtctatgaaaataacataaataaaataaagctttatgaaaagttaaaaactatttatggtgaaagctacaatatgtatgttatatttaatggaattcaaattgccaattctgaaaaatatataataaataatgtgaatttaagagaatttttagaatacaattctgttattgtgaatctagttgttgattcatataaggaattttttagtggaagaaacattaaagaacttttagttgaagtggaaatgttaaagagaaagcttattaaaaaatttaacaaagataaaattgggaaagtgcttataaattcaaaaaatccaatatataatatggcacttatagagtgtcaaagtagaagtaattttgttttaagtacttataaagatataaaagaaaatcttatgagaaatatgttatcacgtggagcagaagaaaaagaaacaatagaagaaattttaagcttctttttagaaaatggacaaaatgtggaggagaatcatggacgataaatctatattaatacaatgtgatgaaatgacaaaaaatatgatgggtgaacttcaaggggaaatgatagaatctttagctaaagtatcaaaaagtatgacagctgaagttattgaaaaaatcaaaccaatggagaaaaaaataaatgacttaaaaaaagaacttggtgattttttagaagacaatgaagaatttcaagagatgattgaaactattaatggtagtatggacagtataacaaaaggaattgaaacaaccatagaatcagcgataatcaaagttataagtgaacagagtaagatggtagttgaacataataaactttttaatgagaatttacacaaattgatggaagatacacaaaaaattaaagagagttttgaaagttcaaatacaataattaatgaagaacttaaaaagttagattcgaaaattgatgagatgacttttgagcagcttgaagataaacttgctattttaggaataaaaatagttaaagatgcaagtaagaataaaaatgagattttagaaaagatagaaaacattaaaactgaagaaatagaaagtaaaataactgaacttgagcatggaattgaaagtaatttctttagcagcaaacagttgatgtgtgaaaaaattaagggaattagcgataaaatagatgaaaaagaaatattaataaaaataattcatggatatgaaaatgaattaagtgaaaaaataagaagtattcaagaagaagtagaatggagtaatagatcattcttttcaagaatttttggtaagaaaagagattagctttttataaaaagaggagagaacagtaatgacatatattgatatagttaatgattctagatttaatgaattattaaaaaagtatatgaatgaaaattcggaatttgattatagagaatattttgagcattttatagagaatctagataaaaaggagatacttattcctgtacttggaatacagggcgcaggaaaaagtagttttttgaattctattcttatgagtgaaaatgtacttccaaccgatgttgatgaaacaacatgtgtgcctgtagaagttcattatggagaaaatattaatgaagctgaagtatattttgttggaaggccaaaggaagttataaaatctgaacagttagaaaaatatgttcacaatgattataatccagcaaatgaacttggggtaagtaaaatagtattatataataatagtgaaatattaaaggataatattgtgctggtagaccttcctggtgttgggagtcttacgcctgaaaatcaaaaaacaacactagattatgtcaataaattagttgcaggtatatttatgataaggactaatcctcctataacaaggacagaaaagaatttcataaatgcattgtggcctaaattatcaaatacaatatttgttcagaataaatggaatgatgaaagtaacgaagatgcacaggatgcgaaggaacacaatgaaggtgttcttaatggaataagtagtgcttacaaggatgataagcatgttaatgtaaatatagtcaatgtatatgaagctgtaaaaggaaaatttacaaaggacagccaactatataaggattctggaatagaaaatgttttagatgagataaagagtatatctgtaaagtataatagttctctaatgcaaactcttgaaggtaaaatagatgaagtacttattagtattaatgatagaatagaaaattatatttcagcatcacttaataaatccagcgaaaatgaacttgaaaaaataagaagaataaatgaaataaaggaaatcttagcagaaaataaagaatattttaagaatattagagactattcttatgatagaatggattatataataagtgaagctacagatataattaattataatatggaaaacttaaggtgtgagctaaagagaataataaacagaggtattgtagatggtgaactactaagttcaatatataaggaactatcagataaagcaataaatagcattatggaagaggttttaaatataacaagtgaccttgttagaaatcttaatagcaaaattcaatatataaaaattaaaggatttgacggtacttatgaaaatatatcgttttttaataaaagaagtacagtaaaatttgaaaaatcacttccatcacttttaggtgtaagttcaggtcttattggtacagttggagctataagtagtcttggaggcccacttggaattttggttggcatgggtattggttttgtcttttcaataattggtgaaaatcttagaaaagagatactccatacaagagcaaattatacaataagagatttagagcctatgcttgaagatttagaaagctatctaaaagaagaaatattagatgatttaagagcaaaacaagaggaagtagattattctattaaaagattaagaaaacaaattgaaaaaacctttaaagaagatattagaaatgtagaagaacaatatgaaaaagattataatgaaaatcacactcttttatttgaagaggatttaagaactctgaatgaattgagaaaaagtttaaataagagctaataagtaaagctctagtctaaaaaaggagagaataaagatgaatatttttgacaactgtattaagagacaagaaaaaatcgattctattgttaaaacacttggaattaaagatattatagataaaaattccttagtaaaggaaagagttgttaatccatctcattatgttgtaatgcttggagaaacaagttcaggaaaaagtgcattgataaacagtatccttgaaaaaaagataatgattgaaagtgtaagacctacaacaggggttgttgctgaagttgttgtttctgacgaagaagatatatggagtaaagttggaaaagatggaagtattactgagttagaaaaagatgaatttgataaattggtagtaaatccaacatctgatatacacagattaagatataaaggaagaagcaaagaggataaatttgcaggaataagattatttgatactcctggatatggatcacttgtagattaccatgaagatattttaaaggaatttattccggaaggagatttcattgtttatgttgtatcgtacagagtgggactaaatgatgacgattatcagttccttaaatatgttggtgaaataatttcagataaagtagaagttatacttgcaataaatatgtgtcctaaagacattacagaagataataaacgaataactgaaataagaaaaaatataaatgaatgcatacatagagatgttgaaactttcttaatagaaagcagtagtgaaaaaaatcctgatgcgcaaaaactttggaattatatttacgaaagagttaataatccagaaaaaattgaagagcttggagaagctttgaaaaattatcaggattatgtcttgggagaatgtgaaataaaagtaaattcaaagatagcaagtattgaatctgctcaaaatgatttaaatgagaggaaaaaactcacaaaggaattttttgaatgtaaagaagaaattactgcaatccttgagagaggattcactaaaacaaaagttaaatctgtaagacttattgacaaggcagctgctacaataaaagaagatgtaagaaaatatgtggaagatgagactaagtggactaaaagagaagaaacatattcatttatgcaacattattacgtacctaaacttacaactgaagaaacagaacacatattaagttacattgaagatgaaataattttattggataaggctatgaaagaaatacttaataagacagccacagttttagaagataaagttaaagttaatattccatgttatagtgaagtaatggaaggtatcctaaaaaaacatattggagatgcaatgaaacaggcagctggtgaaatgtttagaagttttgatagcaagaaaaaaggaaacaaggattcatctagaacaaacttcaagagactagaaagtacagatacagaatatgatataaataataatggtttagctaaattgattaaggcaataagagcaacatcattaaaaggtataactcattatttaagtgtattcacagattcaataatatatctatatgatactttaacatggcagaacaaaatacaagaaatatcaatggaagcaatcgacaactgggcacaagatgttgaaggagcagtaagaaaatacattgatgaatttaaggaaactaacagaagagaaattatgtcattgtttgatgaattgacacaagaatttagtgaagattaaacagatgatgttattgaagatatagaccatgaaactctaataaaattgaaaagagaaatagattttatattacataaatgtctttttgcctctatataaaagagatactataatttgtagttaagcacaaataacgtaatagttatggggtaaacaattattagattagatgttattatataaatccaatatagttaaaataaagctgatgttgttatcagctttatttttattgagtaaattaataaaaatatactaaattcaagtattattatttttttaagaaagtattaataattaaggaaataattattggaggggtaaaggtggatttagttattgttatacttataacatcaatagttatatggaaaaattggtatacattttatcttatattaaaattttataaaatgaataatagaaaggaaactacaattaatattatatttttatttaattatcttatatattattattttctttttatggcagctactgattccatagaatctccacttaatggaccactatggcttattataatatttgtagttttaacaggatgtaatatttcctatgatcttaaacttttgacttttaaagaaaaaaatggagcaaataagggttaataacaataaaatacccaaaaatcaacctttttattaaagctaataaaaagattttaaaaaagtatcaatttttttttgataaataggaggaaatgtgttaaatttatagaataagtattttataagtgggttaaagtggttggaagtggtttttatgtaattaaaaatatatataaaccactatttgtgggggctgagcatattgttcataggagaatatcaacattcattagattcaaaaaatagaataattgttccagctaagctaagggaaggtcttggtaacaaatttgtcatcacaaagggactcgatggttgtttgtatgcctacccgcttgaagagtggaagatactagaggataaattaaaaacgttgcctttaacaaacaaagatgctagaacctttgttagattctttttttcaggagcatgtgaagtcgaacttgacaagcaatttagagggcttattccacaaaatttaaaggaatatgcaaagatagaaaaggacatagtaagtattggggtattatccagagtagagatatggagcaaagaaatgtgggagaactataacgacttaaatgtagattttgattacattgctgaaaaaatgaatgatttaggaatataaggagtttttattatggaatttaaacatgtatcggtgcttttaaatgaatgcattgatggattaaacattaaagaagatggtatatatgtagactgtactttaggtggtgcaggacattcatcgcatatattaaagcatttatctaaaaatggattgttaataggaattgaccaagatacggacgctttaaaggctgctaaagaaagattaaaagactatgataatgttaagtatgttcatagtaatttttataatattgacagtatattaaacgaattaggaatagaaaaggttgatggaatattaatggatcttggagtttcttcatatcagcttgataatgcagaaagaggcttcagttatatgcaagatgcacctttagacatgagaatgaacagagataatgacttttcagcatatagcattataaatgactatagcgaagaagagctttataagataataagagattatggtgaagaaaagttcgctaagagaattgctaattttattgtaaatagaagagcagagaagccaattgaaactacatttgaacttgtagacataattaaggcagctatacctgctaaggcaagaagagaaggacctcatccagctaaaagaacttttcaggcaataagaattgaagttaattcagaattaaagatacttaataaaactattgaagatggagtcaatagactaaataaagatggaagaatggctataattacattccattctttagaagatagaattgtaaaattaaaatttagggaacttgaaaatccatgtacatgtccaagggaatttcctatgtgcatatgcggtaaaaagccgttagttaaagttttgaataaaaaaggaattgcaccttctaaagaagagattgaagaaaatccaagaagtagaagtgcaaaagtaagggttgtagagaaggtataatatttaatatgtatataaatgagtagggatgtgaagaagatgccacgaggacaatacagttatggtataaagggtaatacagctgttaaacctttaaaaaggacgactatacgtaagccaaaaaaaagtgaagagcaaataagaaaaaataagaacaatagaaaaaaactatttaaaaaacagaagcaaaatgacagaaaatatatgcttacagttgttatggttatcctaggccttggatgtgttactgtagctggggatagcaaaatatataaaatgcaaaagtcagtgacaactttagaaaatcaaataagcagcactagcgaagaaaatgaagctttaagagtaaaaattttaaaatattcgtctttaagcaatattgaagaaagtgcaagtaatggtcttggaatgcatataccacatggggatgatgtggtaaagatagatttttctaataattattttaaagatgtaacaagcaataatcatacagtaaagaaaagtaataattcatttttatcatttttagagggaatttttaaataattaaatataagactcagatgatttaatgattcatctgagtcttaagtatttactaagaagagttatggggaactagcagtgaaaaaaaagagttataaacgtaagagtataatgcagaaaaaagctgttatggcaggagtggctcttacctgtttatttgtgttcttaataggaagattatcatatattatgatagtaaaacgcccagaatatgcaggaaaagcagaagaacagtggacaagcgaagtaaaaatagatgcagtaagaggtaagattctagacagaaatggaaaagaacttgcagtatcagctaatgtttatagagtggatcttgatttaacaactataagagcttatcttgataaaagagtagatcagctttcagctacggaaataaaacagagacaaagtgtaggaattcctattcctgtaggcgatgatggaataacaacaagcgatatagcaccagcaattgcgaaggctcttaatatggatgtagaaacggtaaaagcaaagcttgaaacaaaacttgaaagtggtctgccagctggctcagcaactcttataagaagaattgaaaaagaggatgcagataaagtaaaatccttaaaaattaatggaatagtagtttcaaaagatacaaagagatattatcctaataataattttttagcacacgtactaggtgtaacaggaaatgatgggaaaggtcttactggaatagaatctgagtataatacttacctttcaggaattccgggagttaaaataggagaatttgataaaaataataatgatcttccttatggagattctcagtttacatcgccagtaaatgggaaggatgttacccttactattgatgaaacaatccaatcttttgctgaaaaagtggctcagcaggcatatgaagacaacaaagcaaaagcaacttctgttttggttatggaccctaaaactggagaaatacttgcaatggtaaataagccagatttcaatcctaatactccttatgaaggctatgaaggttttgatggagcaactgaaggtgataagatccaaaaaatgtggagaaatagattagtaagtgattcatttgaacctggatctatatttaaagtaataactgcaatagcagctttagaagaaaatttagttaatgaaaatactacatttgaatgtggtggtggtcttgattttggtaacaggcgtattaattgctgggaaactcaaggtcatggattacagacatttccagaaatagttcagaattcgtgtaatgttggatttatgaaagttggagaaatgcttggtaaagaaaaattttatgaatatataaagaagtttggttttggagaccttactggaatagatcttcaaggagaagctgatggtatagttaaaatacctcagaatatatcaccaacagatcttgcaacaatttcttttggacatacaaatactgttaattcaatgcaatatatggcggcttttaattcagttgcaaatggtggaacatggatacaacctcatataatgaaagaagtaactcacaatgatgataatggtgtcgaaattgtggatgaaaaatttgaagcaaaaaatagagaagtggcaagtagtgaaaaaacagctgaacttagaaaataccttgagagggttgttacatcaggttctgcaacagcagcatttattgatggatatcatattggtggtaaaacaggaacagcacagaagatggaaaatggtgcatatatagaaggtaaatatatatcatcctttgttggaatggcaccagtagatgatccaaaagttacagttatgataactgtagatgaacctagcaatggtaattattatgcaggtcaggttgcagttccttatgctcatacattgtttactgatatatttaattatcttaataatcagttctcacaagatgatgttggtaaaattgctaaagaggtagttataccagaagtaagaggaatgaaaaaagaagatgctcaaaaggcgttaaaagatattaagattcaatgtgatatagagggaaatggagatacaattgtaagtatggatccatatccaggatcttctataaaagaaggttccataataaaactttattcgtcaggaagttctgacaacagcaataaggtttcaatgccggatattaagggatattctaaagagtctgcttatgaattattgagtaaacttggaattacagccacatttgaaggtgaaggtgcggctagggatcagagtatatcatcaggagaaattgttccaaagggaacaagtgtaaaaattactttagaaagtaagtataaagattaaagattagacataggcaaagtgttaattaatgcctatgtcttttttgttgtataagaaaccctgtttattaaatcaataaagtatgctgaaaattatattatgtttaatttcttaaataaatattatggtatgaataaaaaatcagaataagaatattattatagtacaaagtgatttgagtattattttgtgaaacagcaggaaaactttttaagtaaacattaaaaagtttacttaaattatcattatagaaaagggatggaggaaacagctgtgaagaaaaagaaattcaaagacaggggcagactagaaaaaggttgtcatatgctgcagcggcactcacctttgtttttgcaacacttactatgagactttcatatataatgattgttaaggcacctgattattctgaaagggcagaggaacaatggacgagtgaagttaaaattgatgccataagaggaaaaatattagataggaatggaaaggagcttgcggtatcagctaatgtatatagagtcgattttgatttgaattctataaaaacatatttaagggcaaagcttagtaatttgactgatcaggaaatagaacagagaaaaagtgcaggaatacctttgccaacagaagattcgggaataaaaacagatgatattgcaccagcaatagcaaatgctcttggtcttaatgttcaagatgtaaaaaagaagctagagacaaaacttccaagtggtgcagatgcaggttcagctacattgataagaagaattacaaaggaagatgctgataaggttaatgcattaaaaataaggggagtaatagtatcaccagatactaagagatattatccaaataataattttcttgctcatgttctaggaagtacaaatagtgatggtgtaggattaacaggagtagaacttcagtataattcatatttagctggaactcctggaatgaagataacagaacttgaaaaaagtaatacagattatccatatacaatatctaaatttacatctcctcaaaatggaaaggatgttgttcttacaatagatgaaaatattcaggcttttgctgagaaggtggctcagcaggcatatgatgaaaataaggccaaagcaacctctgttttggttatggatcctaaaacaggagaaatccttggaatggctaacaagccagattttaatcctaatactccttttgaaggatatgaaaactttgatggaaatactgaaagtgaaaagacaaataaaatgtggagaaatagacttgttaatgatacttttgaaccgggatcaatatttaaggttgtaactgcaataactgctttagaggaaggtgctgcaaatgcaaatactgattttttctgtggaggttcaatggcagtaggaggaatacatccaaaatgttggagaactcaagggcatggtgctcaaaaatttccggatattattaagaattcgtgtaatgttgcatttatacaacttggacaaatgattggtaaagagaagctttgtgaatatataagtaaatttggttttggaaaagtaagtggtgtagatcttccaggagaagcaaaaggtatagtaaagcctgttgataaagtaacagaagcagatttagcaactatttcatttggacaaactaacactgtaaattcagttcaatatatgacagcattaaatgctattgcaaatggtggaacattaattcaaccacatgttatgaaagaaataactcatgttgatggtaatggaaatactgtagtagatgaatcatttcaaccaaaggaaactactgttgcaagcgctgaaaaaacagctgaattaagatcttatcttgaaagtgttgttacagaaggttctggaaagagcacatttattgatggatatcatattggaggaaaaacaggaacagctcaaaaagttgaaaatggtaaatattcaggtaaatatatatcttctttcgtaggtatggcaccagtagatgatccaaaggttacagttatgataactgtagatgaaccaagtaatggagcatattatgcaggtcaggtagcagcaccagctgcaaagactctatttagtgatatttttagttaccttgatgataaattttctgatgagaatttaagccagataccaagggatattgtaattccagaagttcgtggaatgagtgttaatgatgctaaaaaggcaatgtctgaggcaaaactagattgtcaaattgaaggagatggggatactataagatctatgacaccatatcctggctatactgttaaagaaggatcaaaaataaatctttacacaagtggtgatgggaattataataataatgttgtaatgccagatgttagaggttattccaaagaagatgcaaatgagttattaacaagtttaggtcttgtacctgcgtttgaaggaactggaatggttgaaacgcaaagtgtaacacaaggcgaagttataacaaaaggaacatcggttaagttaacattaagtttagattataaagattaaaattatgatcataatgataaatgctagcatgtgggttaatgctcacatgctatatttttaaagtgtagaaatatatagaaggtgatatttaatagaattttatttacttgaacaatgtattattatagataaatatagttaataaagaaaagttaaatgtgaaaaattaaatcaaataagcaaagcttttttgataattaataaaagctatagattttagcaaaattgttaactgttatttttagactgttaactgaaaaaagttgttaggagaggattacatgaacctaaagagtattttaaacggactggattatgaacttttacaaggaacagaggacgtacagataaacaaaataaattatgatagcagaaaagtgtgcaaagatgatttatttgtatgtgtaaagggatacgcaacggatggacataaatatgctgagaaggctgttttaaatggagctaaggttattgttatacaagatgacgtaaatatagatgataaagaaataacaatagttaaatgttcagatacaagaaaagcattagcacttatgggtgcaaattattatggtaatccttctgaaaagatgaaaattatcggaataacaggaactaacggaaagactacaactgcatttatgataaaagatatattagaatgtgcaggcaaaaaagttggtcttattggaacaattgcaaattatatatgtggagaaaaaattcatacagaaagaacaactccagaatcattagaacttcaagagttatttggagaaatggttgaaaaaggagttgaatactgtgttatggaggtgtcttcacattcattagcattagatagagtttatggtgtaaaatttgagtgtggtatctttacaaatcttacaagagatcatcttgattttcacaagacttttgaaaattactatgatgcaaaatttaaattgtttgaaagaagctgtataaaagtaataaatgttgacgataattatggaatacaggtgctaaaagattgccaaaaattaaatgctgaaaatatttactctttttcagtaaaaagtgattctgattataaagcatatgatgaacttatgggaagtagagatattaaatttaaagttgtccttgatgaggaagaagaatttattcttggaattcctggtgaatataatatttataatgctttaggtgcaattggagtctgtcacaagatgggaatagctattgaagctataaaagaaggtatagaaaatgccttggtacctggtagatgtgaaagagtaggtaaagaatataatcttccttatgaaataataatagactatgcacatacacctgacggtcttgaaaatattttaaaaactgcaaaagcattcactaaaggtaagcttatcgctatttttggatgtggtggtgatagagataaagtgaaaagacctcaaatgggtaaaattggtatagatattgcggatttagctgtaattacatccgataatcctagaagtgaggatccaatggcaataatagaggatattaaagcaggtcttgataaagataattatataattattgaaaatagacatgatgcaataaagaaggcaattgaattagctgagaaagatgatgttatagtaatagcaggaaaaggacatgagacatatcagatcttaaaagataaaactatacactttgatgaaagagaagtagtcaaagaaatattagataatataaaaagatagtttaaagatatattttttaagtgatatggacttttactaaaagaaggggcggatggttttggatttgaatatacaggaagttattgaagctgttaacggtgaaatcatagtaaaaaataatgatggacacttcaataaaatttctacagatacaagaaagatagaaaatgataatttatttgttgcattaaaaggtgcaaattttaatggaaacacttatgctgttagtgcaattgaaaaaggtgcatctgttgtaatagtagatgagataaaatttgaaaaagaagatttaaaaagcaaaggaactgtaataaaagttaaggatactaaagttgctttaggagatttagctagatattatagaaagaaacttggtattaaagttgttggtattacaggatcaactggtaaaacttcaactaaagaccttattgcagcatttttaagtggtaagtataaagtattcaaaacacaaggaaatttcaataatgaaataggtcttcctttaatgatatttgaacttaataaggactatgatgtagctgtgcttgaaatgggaacaagtaattttggtgaaattaatacacttgcaggaatagcacttccagatatagctgcaattacaaatgttggagttgcacatatagaatatttaaagacgagggaaaatatacttaaagagaagatgagtatttcagatttctttaaagatgatagctgtcttgttattaactgtgaaaatgatatgttaaagactgtgaaagatgaagatcataagaatataaatattcaaagaacaggatatgataaaagttataatctatatgcaaaaaatatagaacttacaagtgagactacttcatttgatgctgtttataaagatgaatgccatagatttaacttaaatatggtaggagaacataacgtattaaatgcattacttggaattcaaatttcaaaagatttaggtcttaaatttgaagaaatggaaaaaggtcttgataattttaaggcaacttcaatgagactggaatttataaaacataataaatttacaataataaatgattcatataatgcaaatccagactctatgaaggctgctattaatgtacttaaaagttatactggtgatagaaagatagcagttcttggaacaatgggtgagcttggagattatgcaaatatagctcataaagaagttggagagtttgctaaaggaaaagcagatattttacttacaacaggtgaatacaaggatagctataaagaaggatttggaacaaatacattagtttttgatactaaggatgatttaataaagtcactaaatagcatgattaaagacgaagatactattttagttaaagcatcaagaagtgcaaaatttgaagaaataataaaagaaatacagaataaataatacgaaggaggtgaactgcctaaagttaggcagattaaaatgggggacacaataaatagtttgttcagcacgacaattttagcaccattagttatatcatttatattttcattaatacttggacctatattcataccaatattacacaagttgaaatttggtcagaatattagaaaagaaggtcctaagagtcatcagaaaaaagcaggaacacctacaatgggtggtataatcttctttatttctgtggcagcaacaattttaattatgggaccaagttttacagatcccaaaatgataattctttattcatttttagcatttggatttataggatttttagatgatatgttaaaaataattcataaagataatcttggacttaaagcaggtcaaaaaatgattttacttcttattttttctgtagcattagcagtttatggatataagaatattggaacagatatactaatacctttaggtagtggatttaaattaaatcttggattattgtatataccatttattattatatattatgcagcagtaacaaatgcagtaaacttaactgatggtattgatggtcttgcaacaagtgtgacaataatagttttaactttctttacaatagttgcatttaaaactggtcaaaaggacgttgctattttttcaatagctttatgtggtgctttattaggattcttaaaatataatgcattcccagctaaaatttttatgggagatacaggatccttggcattaggaggagcagttggaactattgcattaatgcttaagatggaactatgggtagttatcgtagggttaatgtatgtagttgaaacattatcagttattattcaggtaacatcattcaaaatgacaggaaaaagagttttcaaaatggctccgattcatcatcattttgaacaatgtggatggagtgaagttaaaatagtaacaatattttctttagtgacagcagttttgtgcataataggttttatagccatttagcaatttgatttggaggatttatgtatgaaagtcagtaagcccaaaaagagaaaaagaagaattatgggtgaaatagattatggtgtattttatacggtattactattagtggcagtaggaactgttatgatttattctgcaagttcatattatgcaatgtttacttatggcgacagtatgttctttttaaagaaacagttaatgcttgtaccactagggttctttgcaatgatgtttatgatgggatttgattatcacaaaataaagacctattcagtatgggtattattagcatgtataccgttattatttgcggtgttctttttcccagatgtaaatggagcacagagatggataaaacttggaccattaagctttcaaccatcagaccttactaaatatgcagtagtaatatttttagccatgggattagaagcaaaaggtgaaggacttaaaaagttttggacaggaatagtaccttacttaggtgtttcgggtatttttgcagcattaatattggctgagaaaaatttaagtatagcatctgtaataatgatagtaacattcataatgttatttgtagcaggtgctaaggataaacatttattcggagtggtagctccagctatgattgcggcagctacgtttttcacaatttctagtgattatagaaaagcaagacttcttaattttattgatccatggaaagatgcagctggaaacggatatcagcttatacaatctttttatgctttaggtgctggaggaataacaggattaggtcttggtcagtcaaggcagaagactttatatatgcctgaaccacataatgactttatattttcaataattggtgaggagcttggattaatagggtgtatatgtataattgcattatttttagtctttatttggagaggaataaatattgcattaaaagctaaagacacttatggtacacttttagctgtaggaataacatctgttatagcagtacaatgtttaataaatattgcagttgtaacaggatctatgcccgttacgggtgttccattacctttcataagttatggaggtacctcacttgtgataaatatgacggccatgggtatacttctaaacatttcgaggcagacggaaggtaaagatgaatttaaagggtagttataattcatttgttaatgggtaaagaaataagcagaatggtaaataatatttattactattctgctttttaaatgaattaatttagaataaaaaggttatatgaacagtacttttcttaattaattaaaaatgtaatgaaaatatacatgtaaagtggtattattatatatgaaatttatgaattataatttagattgaggtgagtacaataaaatcagttaaaaagcctaccaatgagtttgtcataagagcacgtaagagaaaattagtaaaaaagattatacttatgtgtgtaatattatttataggaatcattttatttataacaaaatcaaaggtatttattataaaaaaagtttcaattctaggaaatccaattatgagtggagaagatgttaaagaaaagacacaatatttgattggagaaaatatattctttatgaaaactagtgacataataaaagcagcagaacaaaatccatatgtaaaaacagttgagataagtaaagcatatcctagacaggtgaatataaaaataactgagaaacaaggaattttttgcagcgaaaaagatggacaatactatatttttagtgataaaggagtattgcttgaaaaggctgataatatagataacagaaatctaatacagatactaggacttgatgaacatgtaggaagtttagagcttggggattctgtaggtacaaaccaaagaatgataaatgttttggaagttttttctcaaatagaagaagtcaatccaactaattataaaatagattctatcgatttaagtgattttatgaatataaaagtatatatcggaggcgttgaaggaagactaggtaatgatgagaatatacctgataaaatgaataaattaatgcatatcgttgaaaatactgaaatagggattgaaaaagggtatgttgatgttggatttgatggatctccaatttattataaagaagaagtgaaaaacgaagaagggaatattaaaaatgaaggtgtctaaatcacaaatatttatagcaattgtttgcggtttgctaggttttttattatcatatcagtttaaagttttatcaaagcagaattctgctaatttaagcacatacgatcaaagtgatattatttctgaaatagaaactttgagaaaagaaaaagaagaattagtttcaacaaattcaaaattgtcagatgaattaaaacaacttgaagaagcagcttcaaaggatggcgatgttggaaaagaaattaaaaatcagcttgatgctgcaagaatgcatctaggagttgtagatgttaagggaccaggtatagtacttacaataacaccaaaaacgtctatttttaatgctaattcaaatgatacaagtagagaccttggagaagatgaaattgttcatgttgtaaatcttttatggtattctggtgctgaagccatttcgattaatgacataagaataactccacaaacaggaattaaaactgctggaaacggtatttctattggatcagcaggaagaatatatcctaaagaaaaaattataataaaagctataggggataaaggaagacttaatgtaggattatcatttccaggatctttggagtatttagctcttcctaattataataatgaaataaaaacagaagatgaaatttttattgctaaaactactcagtcattaaaaaatgaatttataaaatcagttaaagaataggagatagtaaattgattgcaacggttggattattaattggaataatattgggttttgtattagatgtaaatatatcagataaattatcgccatatatgtcagttgccatattagcatgtttggattcagtttttggagcagttagagctaatttatctaaaaattttcagccagatatttttatttcgggtttttttggaaatgcacttttagcggcattgttagcttatttaggagataaacttggaatacctatttatatagcagctgtaattgtatttggcggaagaatatttgataacttcgcaattataagaaggcttttacttgaacagtttaagcaaaagagaatacataagatgagaaagaagctaagggcaaaacaaaatctagatgatttttaaggggtgtgtaaagtgaagaaaaaacctcaatacttctttattttcatagccgcagtaatgcttggatttctaatagctataaattttaattttgatagaaaacaatcatatacatcattaaatacaatggaatatcaagaagcaattgaagagagatctagattgtataaagaaattggagctttaaaggaaggaaatattgatgctaatagaaagataaatcaatataagcatgatgatatgaaaaatgatgaaatacttcaagatatgaaagaacagattgtagattatggaatgtttactggccttactgcggtagaaggtcctgggataatacttactcttaatgatggtgtaacagatgtaaaagaagaaggctttgaagctgttatgagtaagcttcttcatgatagtgatatggctctagtattgaatgaattacgacaggcaggagcagaagctataagcgtgaataatcatcgtattgttccatggtctggtgttgtgtgcgcgtgggcatttatacaatttgatgattatagtatggaatcagcaccatttaaaatttatgcaataggcgatcctgaaaagcttaaagcagctcttcttgaagatggaagccacgtaaagcagcttatgataaagaaattatttgttcaaatagaagaaagtgaaaaaataacaatgcctgcatccacagccatgggtaatgtcacatatatggaaagagatgaatcaggaaaataaaaaaatattatttttttaaaggaaattaaagttttttatagaatataaacaaaatgaggtaaagaaaggatttagttataggtgcagtacaatgggaataaaagaaaatatagaataccttaaaaaaagtattccagatgatgtaatgcttctggctgtatcaaaaacaaagccgttagaatacttggaagaagcatataattgtggaatgcgtgactttggagaaaataaggtccaggaacttgttgataaatatgaaaattttcacaaggatgttagatggcatcttattggacatcttcagacaaataaagttaaatatttagtaggtaaagtttttctaattcactcgctagatagtgtgaatttgttaaatgtaatagagagagtttttgaaaaagcagatttaactgcagagactctaattcaaattaatattggaagagaagatagcaaaacaggaattttagaagaagatcttgaagagtttcttcaagaaattgaaaaatgtaaacatgtatctgtaaaaggtataatggtaataattcctcagggagatgaagaaagcaatagaaattactttagaaaaactaaacagatctttgaagatttaaagaagagaaagtttaataatattaatatgcagatattatcaatggggatgacacatgactatgagacagcaatagaggaaggttctacattagtaagaataggaactggaatctttggtgaaagaaattatataacaaagtaggagggttatttatgagtaacaatgttttatcaaaagttaaatctttattagggtttgaggattacgaagattacgaagattacgaagatgaagaatatgaaagtgaagtaagagaagaagaggaatcaatcgaaccagttataacaaataagaagaataataaagttgtaaacattcatacatcaacgtctgtgaaagttacaataactaaacctgttgattatgaagaagctacagaaatttgtgaagctttaaagaacagaagaatagtactagttaatactacagtacttgaattaaaaattgcacaaagattattagattttataagtggatcatgttatgccttaggaggagaattacaacaaatagaaaaaggagtttacttattatctccatctaatgttgaagtaactaatgaattgaaaaatgaattaagttctaaagctttatttaattggtctaaataggagggaaaatgttaatacaagctataagtggtatatttagaataatcgaattagcaatacttgttgaatgtatttcatcatggattccacaaatgagatacaatcagtttatggatatagttcgaagcattacttatcctatcttagaaccatgtcgaagattgcaggataaatttgtcagtgattcaccaattgacttttctccaatacttgcattatttcttttagatataataagaggagtgcttataagcttactttattagtattatgaaagaattaattagtaaacaatttggtgatgaagataaaaatgaagtgcttaatttatatgaaaaatataaactggcaagagataaagaaatacctatgttcgggaacagtttttatactcctaacatatggcgatggtttgaaaaaaattttattaacagttcttgcaaagtagaaagtaacggggtatttgaagattcagaaagaaggatgatttcatttaataatgtgtataacacatcttttcctatgaaattgttgaaaatagaaaatacgtcgaaatttaatgaacttacccataaagattttttgggaggaatattagctcttggaatagaacgtaataaaataggtgatttattggtcaaagataatgtttgttatgtaccaattcatgaagatattgaaagctttcttatttttaatatagataagataggaaagtcttcttgtaaaattgaaattttagaaaaatatgattctttacctcaatttaatttcaaagaagaagttattttagtttcttctttgagaattgatggtatagtgtctaaattagctaatgtttcaaggggaaaagcacaaatgatgattgaccagggaaaagtgctggtagactatgttaagataagagataaaagttacgagccaaaagaagatgagagaataacaatccgaggtgttggaaagtttatattaggaactatagttgggtcaagtaaaagcggaagacttaaagttagtataaaaaaatatacataaatttagaggtgaaattatgaagttaactccaatggacataaataacaaggaatttaagagagcattaagaggatattgtgctgatgaagtggatgaattcttagatcaaattgttgaaaattatgaagaattatataaagaaaatgccaatatgaaggaaaagattacaaatttaaatgaaaaagttgaacactattctaaaattgaggctacaatacaaaatacattgttattagctcagaatgcagcagaacaagctaaaaactctgctaaaaaagaagctgaaatgatggttaaaaatgcaaatgaaacagcacaaaaagttatggataaagctcataatgatgttatttctataaatgatgaatatgaaagagttaaacaggaatttataaaattcagagcaaaatatagaaattttatgaatacacagttagaaacttttgatgatttagaaaaagattttattaaaaattataatgtttcagaacctattgaagaagatgaattatgcgagaaagaagcaagtgtatctatggatgaaaatgaaaaagatagagatgatgcttcaaaagaaacttttaatgaagatttaaatgaaataaaaagcttctttgttaacgaataataaaaaatgagcttacctatattatttttaggtaagcttatttttataaaaagaataagtttttttaatatatatatgaactacataaggaatatttcatgcataagtctcataagagtggtgtaatattaactttacattgtaaattaaaatggattataatataatgttttagagaatatgtagaagaaagggtctgcgttatggaaaagacattaattaaagttgatgaacaagacgaaggtcttagaatagataaatatttatcaaatatatttaaagataaatcacgatcttttattcaaggattaatagaaaaggaaaatgttaaagttaatagcaaatcactaaaaagtaattataaattaaaaaaggctgacgaaattgaaataatgataccagaacctgaaatactaagtgttgaagctgaaaatatacctattgatattgtttatgaggatgaagatgttatagtagttaataaagcacaaggaatggttgttcatcctgcaccaggaaactataatggtacattagtaaatgcattactttatcattgtaaagacttgtcaagtataaatggagtgataaggccaggtattgtacatagaattgataaggatacatcaggaattcttgttattgcaaaaaatgatgatgcgcataataaattaagtgaacaattaaaagatcattcaatgaaaagagagtattatgctctaattgaaggaagactaaaaaataatgatggaactattgataaacccttaggaagatgtaagaaagatagattaaaaataggaataatagaagatggcaagagagctgtgactcattatgaagtggttgaaagatataatggatatacacttgtgaaatgtgtcttagaaacaggaagaacccatcaaataagagttcatatggcatctataggttttcctcttgttggagatccattgtatggatttaagagacaaaaatttaaacttgagggacaggtacttcatgcaagaacattaggatttatacatcctagaactggtgagtatatggaatttacaagtgaacttccacaatacttttgcgatttaataaataaactgaaaaacgaaatgtagaagttaaaagttaaggaggcaaatttatgaaattaaaagcaacattattagatgaaaaagctgtaaatagaactttaataagaatttctcatgaaataatagaaagaaataaaggcgtagaagatatagtattaattggagtaaaaacaaggggatatcctttagcaaagagaattgctgaatatataaagagtatagaaggacgtgaagttcctgtaggttatgttgacataacattatacagagatgatttatcaatccttgatgaaacccctagagtaaagagtttagatttaggtgttgatgttaaggataaaaaggttatcattgttgatgatgttttatatacatgtagaaccataagagcagcaattgatgcaattattgatgttgcaagacctacagtgattcagcttgctgttttgattgatagaggtcataaagaacttccaattagagctgattacgttggtaaaaatattcctacatctaaaaatgaaattatagcagttagtctaaatgaaattgatgggaatgattcagttaagatatatgattctgaagcagacgaatagaaggagaaaaaaatatgatgcatgaattgatagctacaagtactttcggtattgaaagcataacagctaaagaattaagagctcttggatatgaagatttaaaaatagaaaatggaagagttacttttgaaggtgatgaaatggatatagcaatagcaaatatccatttaagaactgctgatagagttcttattaaaatggcagaatttgaagcacgatcttttgaagaattatttcaaggaactaagagtgtggaatggagcaaattaattcctatagatggagttatgcatgttacggggaaatctataaaatcaacacttcatagtgtaccagactgtcagtcgattgtaaaaaaagcaatagtaaaaagtatgactgaaagttatggaatagaacaatttagtgaaagtggacctgtatataaaatagaagttgcaatactaaaagatgttgtaacacttacaatagatactacagggccaggattacataaaaggggatatagagaacttgctggaattgcgccattaaaagaaacattagctgcatctatgcttttaatttcaagatggaatgatgaatttgaacttatagatccattctgtggttcaggaacaattctagtagaagctgcaatgatagctcttaatattgcacctggtgtaaatagaaattttgtttgtgaaacttggccttcaatggataaagatatgtttgaatcagtaagagatggtgcaagaaattcagaaaaacataaagatcttaaaattataggatatgatatagactataaaactcttaaagtagctatggaaaatgcaaagaaagcaggagttgataagtatattcaattccagaagagagattttatggagttctctacatcaagaaaatatggattcattgtatctaatccaccttatggtgaaagaataggtgaaaagaaagctcttgatgaattatataaacatatggggctaccaagagaagactagattcttgggattttaatattcttacatcctttgaaccattcgaaaaaactctaggagttaaatctactaaaaatagaaagctttataatggtaaaataaaatgttattattatcaatactttaataatgataaaattaaaagtgatggagatactcttataaaagcaattataggctaagggtttataaaaagatagaaaatatatttacagagattaaattatatggtaaaatatatttaataaaatattttgaagcgaagatgctaaaaaactgtttgtttttttagcatctttttttcgtttatttttaatcagatttaagattaaagtgagaatgataacatatcaaaaataacatttaaaaggggaggagaattaaaatggcagaagtatatcaaagagtagcagaaaaattaccaaatatgagtaaggctcaggaaaaaatagcaaaatatatattatctcatcctaatagcacaccatttttgacagtagagaaattagccaagctgtctggtgtaagtattgcaacagtgacaaggtttgtaatatttttaggttatagcggatatccagaatttttaaaggatacacagcaatcaatgcaacagcaggtaaataatagtgaacggataaagctaggggtcgaaaagaattttagcaaagataaatcaatatatgaaatttttgaagaagatgtaaataatataaagactacagttgagaatttaaatgtttttgagattagaaaatgtgttaatcttctccttaatgcaaagagaatatatatagttgcaaaaaggagttcagcagctcttgctgtatttttaaaatattatttagacctcatgttcaacaatgtaattatagtcgaaaatattgaacagatgccaaaacagattaataaagattgtggtgaagatgtaataattggtataagttttgataaatattcaagaagtacagtggaaatattcagccacttgaagagaaaaggtgcaactacaattgcaataactgataatatgttgtctcctcttgtaccatatgcagatgttacacttgcagcaataagtaagggttcaaaatctatagaatcatttgtggcaccactcagtcttataaatgcgctaattgtctctatagaatgtgaaaaagaagattgttttgcaagtaatgtacagcttctagaagaggctatgaaaaagtttgacttgtttatataagcttttttaaaaaagtaagaaataagaattagattaagatattctaagaataacattaatctaattcttattttattattgtttatttgaattatttttttcgaatttttttgtaaattcattaggattaataataactgttttatttgtatggtagataaccattccaggttttgcaccattaggtttttttaattctttaactttagtatagtctatagaaagctttggagagtttttccctttgctatagtaaccggctattatagcagcttcttctaatgttgtatcaggaacattaaagtcacaaactataacgtgagacccaggaatatctttagcatgaagccataaataatttttattagcaaatttaagacttaaataatcattttgaagattatttttaccaacatatatatctatattatcacttgaaacaaagtgatgtggctttgaagttttatttttcttgccattttttaaatttttattgaatcttatataacctgtttcaataagttctttttttatctcatcaatttcatcatagctctcaacattaattatatttgtaagtaccgaattcaggtattcaatttcttcttcatttttagaaagttgcatttttgcatattcttctgaaaccttaagcttattgtattttttataatatctttgtatattctcagatggagttttattactgtctagtgaaattgtgatatattcttcttcgttttcattatagaaatttaaaagagaacattctttgtcacctttttttattgtataaataaaggaagttaataaatcccctttgattctaagttcttctttttcttcacattcttttaaagtttcatgaagtatttttgcttttttattacaacgttcaatattagtatgaataagcttctgaagatctgttgatttattttgaagtctatcttgcttatcttttttactataaaaatcatccataagttcatttggatcatcataagatattgaattataatctttttcaaaaaaagataaatttaaagaataaaagtccttaattaatccagttttggttgtatatattttaaaagatagatttttatcaagattatccattaaatctttaaagttattgtaaatttcagttcttgtaggtgattgtattttttcagttagtgtaaaatacaaatcctgagataatagcttgcttactccagtaaagcatgcagaataaaatttatcatcaaaaataagactgttactgcttatataattgttaaattcatcatagctgcaagtgaaaggattgagtttttcggattttggaggaaatacatagtttacaccaggatagagaactctataactgtttatatcgggagttatatgttttattgattccatgactttattatctctatctcttacaagagttatatttgaatgacgacccattatttcgataataagagagtagacactatcaaaacctaattcgtctctattttcaatttccatgattagaattctatcactgtctttttgagttacttttataatccttccgcctagtatatattttctaagaaccattaagtacattggggcttttataggattttctttaactgtttctgtcaagtgaatccttgcaaagcgtggagaggatgatattaataattttatatttttacgatcttttcttaatgttaatattatttcgtctttttcaggttgatttattttatctattttagaacctagaagtgtatcttctaatgatctcattaaactgtttaagtatattccatctaatgccattatttttcacctttctttatgggattaagaatagtataacattatatggagactattatcaattattaggttaatcttaaaaatattcattaaataaaagaagaaaatataaaaaataacataaatttatgaaaaatttatgatatttattgtaatttaggtctaatacttttattatttaataagtagtgtttaattaatagcaaatttgaattggggaagaataatgaaattttataaaatgcagggagcaggaaatgattttgtatttgtagaagattttaataatcaaataaatgatgaatgtaatctagctgttaagctttgtgatagacattatggaattggtgcagatggtcttgtcattgtgagaaagtctcaagttgcagaagcaaaaatgataataattaatgcagatggatcaagggcaaatatgtgtggtaatgcaataagatgttttggaaaatatgtgtttgaacataatatagtaaataaaacagaattttcagtggagactggtgatggtgttaaaattatagaagtattacttgaagatgaaaaaattaaatatgtaaaagtttatatgggtaagccttcatatagagcagaagatattccattaagtcatggagaagattttatagatagtgaaatcacatgtaatgggaaaacatataaagcaactacagttttagttggtgttcctcatacaattatttttgaaaatacagatgaatatgttgttaatgaagatggaccttctttagaaaaacacagtctttttactgaaggaagcaatattaattttgtaaagataatagatgatacacatataagagttaatacttgggaaagaggtgcaggagcaacacttgcatgtggaactggctgttcagcatcagtagtagtcgcaaaaaaattaggattagtcaataaagaaaaagagatttatgtaaaagcacctggcggtgaacttataattgaagttaatggggatgatgtatatatgaaaggaccagctgaagtggtttttgaaggaaatactttaatttaaggaatctgactgcttttatgtaaagagttaatatttaaataatgattaagagggattgatatggcaaagttcaaaggaaagtttttatgtgtgttagctttcagtgtgtgttctctgttcattttagggtgcaattcaaataaaaaagaagtaccgtctaatatggcagagaatattaatttaaattcaggagccgttttaaaaagcgagaatggggattataatttatatgattatagtgaaaagtatacaaaacaggaaactgataagctagttttgacttatgataaaagcagtagcaattatgtttatagaaaaaatggagaaacttttgcagtttacaatgaaaaggaaattaaaattgaagattctgaatatataaaattaaaattatctcctggtggaagttatgtttcatattttgttgatgacaacgggatgaaattaaagataattaatcttaaagaaaataagttcgctgagataaaatccaatgtgtctatatcaggaacattatatgactggtatgatgataaatcacttgtatattatggtgtcagccaagatggtgtaaatggattgtttatatataatatagaggatgataaagaagaacttctatataagttaaaagaggggtatttagcttatttgaagggaaccatagacaatatattatttcttcaattaaattttgataatgagagacagttcatagctttaaacaaaaatacgaaggacatagaaatattaaataataatattgaagagattaaagatgttgtttatttaaataatgatgtgttttttgttggaagagtaaaagataatgttaattcattatataaaatcgaaaatggaaatacaaagagagttgcttatgactttccagcggttattgatacagaaaaaggaattgaagctgattctgaaaataatattttattcataggaaaaaataatccgagttctggtcaagagcaggtatttaaatattcaaaggatggaagcataagtagtatttcagatggatcatctgattatgcttttgtagaatacgtagagtaatgatacaagatgcaatttataagtatgttaatgtaatttaataaatactattaaacagtagtttagttaatctaagctgctgttttttcttttggagaagattaaagaagaaatgaatattaatggaaaaaggtggacataattaagctaaatatagtcagtaaaaaatagatataggggtgatgatttattaaagattattcaataaatgatgtggatttaaatgttatacatggtttgaataaagaaataagtgataaatataatgttattcccgttaaagaagatgaaaaaaatattactttattaggatacaacataaaagaagatgaacttgattacctaaaatttatttatagaaaaaaggttattctaagggtagtatcagaagaaaattttaaagaagtaaaaaatatgatttttacatttagagaaggaaataccgaagataatattatatttaagggtatagaagataatgcaagtgatatacattttgagcctcaaggtgaatgggtaaacatacgtcacagaataaatgggactctagttcgtatgcataaaattccaaatgaagagtatgtaaaagtaatttctaaaataaaacttatgagtggaatggatattgcagaaaaaagaaaacctcaagatggaaaatcagttattgaatataatggaaaaaaatatgatttgagagtttcaactattcctgtaattaatggtgaaaaattagtaataagaattttatattgtgataattttaactataatttagaaaatcttgggtttacagaagaaaagatagaaataatacgaaaaatgatttctgtaaaaaatggcatggtaataatttgcgggccaacaggttcgggaaaatcaagtactttatatacaattttaaaagaactaaatgcaggaattttaaatataacaactcttgaagatccagttgaagttcagatgcctgaagttaatcaagtaagccttaataagaaacttgacataacatttgcaagtggattaagaagtatactaaggcaagatccagatgtgataatgattggagaaataagagacgaagaaacggctgaaatgtcaataagggcatcaataacaggtcataaagtatatagtacaattcattgtaagtcacctaaagaagtatttatgcgttttgaaaatatgtgggtgaagccatacctaataaaggaaagtcttataggtgtcatttctcaaaggcttattaaaagattatgttcaaattgtaaatttgttgatgatgaaaaaacttataaaaatcataaaatatttaaaaaaagtggatgtgaattgtgcaaatttacaggatatgaggggcgacaggtggtaagttctgtatgtagctttacacatgcttttaacaagtctaatgatgcattaaaaaacaattcagaatttttatcaaatagaagtatgaaagaagatgcagaaagccttcttataagtggagttatatcctatagcgattatcttgaatttatagaaggagagaggcttaatgaataaagaaaaattgagaaaagctgatatgtatgaggttttggaagggaaaattgtaaataaagtgcgcagtctgttttctgaaaaaagaaactttgtaataagaagaggtgcagatgaaaagcaagtatcatttatcgctagaagtctcggagaaatgtataaggatgggattacaattaataaagcacttactttagttagagaaagtgtatcacataaagaatataagaatagtttgaaaactattcatagtgccatacacaatggtaagggattaagtgaagcatttaaagaatgtacacctctgtacccagaattatttataggtcttatatttattggagaaaatacaggaaagttatatgaaatattaaaaagacttggtaatttctatgaaaaaatatgtgaaattaaaaatgaagttaaaatggcttgcatatatcctttattcataattatttcaataataagtttcataggtattttcatatgcaaaattatacctagtttttatggaatatataattctatgggaattacaccatcttacttttatagatgtgtatataattttcaaaacaattttacagaaagttattttgtaaacatgacttatattttatgctggacagttatatggtttatgactattaaatttatgatttccaatgggaaatttgattttttcttaaaagttggattaataaaagatgttttagaatatataacaatacttattttttccataataactaactcaggtatcaatattttacatggtcttgaattatgtagtaacaatataaaaccagagtttttaaacagcaaaatattagaaataagaaattctataatgaaaggaaaaaccttaagcgaatctttagaagaaagtatgctactgtcaaattatactcttgctgttatcaaagttcgtgaagaaacaggaagtattgcggaaggctttgaaatcctatcaataaggcttgaaggtgagatccataaaaagattagaaattatttgaaggcattaaatccactattgattattgtaatggggacaatagtacttatttttatttcagtttttgtacttcctttattcaaagaattgcaaagtggtatacgttaatatgggaaaggttaaaggatttactttaattgaaacagtaataagtatttttatattaacattggtaattacaataactacatcaataagtactatgaattctaatttagaaaagcaaatagcatatgattgtgatatttatgaagtacaaaattttttgactttgagtaaagctgcctgcagaaaagaaaatgttaatggtcacatacttataaattcaaaagatgaggaaatgtatttttattatgatggaggaatttcaagtttgtttagaaaaatgaacttatcaaagaattctgattgtcttggtaaaaacacaaacatatatttagacgatgatggaaagataaagtctggaacaacaatatcaataaaaaatgatgatgatattactaaaattacagttggagtaggtgtggacacaataagaattgatgaataaaggattcataatttaaggagaaggtagttcttatgaaaaagtcagaaggcagtatattaattgaagtaatggcatccatattaatgctatctatagcaggtatatttgtattgtcaacaagtttaaaatgtttaagacattatgagaataggagtactgaagaaaaacttaatagggttgttaatatgttgattaaggaatgtaagtacaataaatctaaagaagagttagaggaatttttttgtgacaatgatgtaatttattttaagtatgatgagaatatagataataaattatttgatagtgatattttttgtcttgaaagtggagatgatattgaaattcaaaaaataagtgaagataatatgggtactagttataagattaaagtaagtattgataacgaaaatatttattatgaaagggaagaggaattttataaaagttggtggatggatgaaatataaaaagagtggatttacaatattagaatcaattatatatatttttttatcaacaatgattattgcagaaggattaaatctatttatgcctatgtataaaacatatcttgagattaaaaacaagagtatacgttctaatgaatatgaaaatttttatattaatttaaataatattataagtgaaggagctattgataatatagttatcggtaatgactatatgactttatgcaaaagtgagtttggagataatttaaaaaagaccatacgtgtacatgataaaaaaatagtagttgtatattcaagaggagatgaaattttgacttacaataatatgctctttaatattgaaaaaatagaaataaataaaaaagaaaatttaatttatatgaagatatatgatgaaaatggtgataagtatatatgcagcgtgtaagaaaaaaaggttttgcactaataaatacaattattattatttcattgttgatgtcaatttcaagttttatgttcattcttatgaaaaataacatagatatttcatctatgtattgcatagatgatgatatattttctgttgatgataatgaagaaaaagtaatatatgaatttatgaggatattaaataataaaaatgaaaacttaaagaataatgaacatgaaaataaagatttaagcgtgacaagtgatgatgaatatgagaatttgagcaatgtttcaaataaagtaaaatatattgattttgaggaaagtttaaatattacagatatattttatgaggattttgaagaagaaaacaaagggaataaattaaaatatgagaagtcggcagataaaattacattaaagatttatggtaaatataattcattaagagtaagagaactaaaatatgttataaaaaatgacaggataattttattgcctacatctaattttattgatactaatactgaatttgataaattgtaatgaaaattaaataagtcattaatatgtaatatgaaaagtgaaaaagaaaggaagtgcttgatgaaaaaagatattgtatttataaaagacaattcctttgtttataaagataatgaatatggtttttatgaacttttagataaaaatatgaaatttaaaaacttaaaagcagttgtgcttggagaagagttgtatataaaaagtattttgattaaatctaaatattttgaactagaaaagtatatagctaatgaaataaaaaatatattttctcagaatggtgaaatactctatgattatgaaaaaagtgagaatacaaactctgtgtatatatattctattaggggaaaggaaaaagtggagaagttatgcagtcacacggtttttcttgaagttacaccattacagtttattattagaaagacgttaaagaatatttttaaaaataaatgtaaagattatatgagtctcataaaatttgataataaatattattttataaaatgtagtaatgatgtctttattgataattatgtgtcaaaggatcttgaaaaagtatgtcagtatatagattccaaatatgaaaaagaaacaatcattattgataataaatgttttctagatgaatattctttagaaaaactggaaataataaaaaaggatattgtggggctataaatgagaatgtataaaaaatataaaaattttataccagatagtttttatataaaaattagtgaacaaaaaaataaaaaacaaaatatattaattaatttatttgtgatttttaaccttatatttatacctattaactttaaaaatctaagtattttagctgaaaaaaatgtgaaaattgatgagcatgaatcatatagtgataaaggaagttttaacttgaatacaataatatgtgtcattgatgaactttttttagatgattttgaagatgtatatataaataatcatgctggagaaataactattaataatttaaaaattgcagaaaatataaacaaaagcaaattagtggaaatgaacgaagcgtcacttatagaagatgaaaaatataagataggagtttctataaatgaagagtaaacttaagtatattgcaatagttctccttatgttaagtgcttttgctcaaatctgcctaaataacatattaattaaaagaataaatataaaaccagtaagtgctcaggtaataaaaaaatataaggacttaacacagttaaatagggagataagtgaattaaataatacatcaatattaagtgcagataaaaagaataatatatggtatgctcagttgaaaatatctggagataaacagattattttagaggaaattaaaaaattagaaaaatatgaaattaacaattatattataagcaaaaataatacagaaaattgtgttataatcgatatatgtggcaatgaataagaacaaatatgataaaatagataattttttaggagaaagtaatcataaataattgcatttatgactgtcttttgataaaatatcattgttatgtcaacgagtaagtgtatatactagtatttaagtattaaatttgcattgtaattattttataaatttggagggatattttatgatatcagcaggagacttaagaaaagggactacttttgagtttgatggacaagtgtttacagtaacagatttcttacatgttaaaccaggtaaaggtgcagcattcgtaagaactaaattaagaaatgttatctctggaggagttgtagatagaactttcaacccaactgaaaaattacaagaagctgtaattgaaagaaaagaaatgcaatatctttacaatgatggtgaattgtactacttcatggatcaagaaacatttgaacaaattcctttaaatcaagaaaaagtagaagaagctattaagttcttaaaggaaaacatgtttgcaactattaaattcttcaaaggtgaagctttctcagttgaagcgccaaactttgttgaattacaaattactcactcagaaccaggagtaaaaggaaacacaacaactaatgcattaaagccagctacagttgaaactggtgctattgttaatgttcctatgttcgttaacgaaggtgatgttatcagaatagatacaagaactggggactacatggaaagagtttaatctttatgtatttatgtaggttgctaagtaatatacttagcaactttatttgcatatgtgtactttaaataaaaattgaattttaaatttttatttaatagagtttagaactaaggaatgtaattagattattagaatgtttaatatataatatgaacaggaagtgaaaaggtatggaagagcttagaaacgaaattgaagagttaaagaacagtttatctaatgtagacgatgacaagtataaaaaatactttgacagcatacaatctattttaagcacaatggcaaataagattgaagaagttgttgtaaatcaagaagcaatagaagaaaatatgcagttcttagatgatgatttatcaaacattcaagatgaattatttgaagaagtatccattgatgaattgtgtgatatggaagatgagtatgttgaaattaattgcgctcattgtaataaaccaatttttatggaaaaatcagttttaaccagtaaagaacaaattccatgtccttactgtcatgaaaacataaagtaatttattaataatagtagattataattagtaataaaaagcctcgtaaaataaacaaattaaagtttattttacgaggcttttatttgtttacatatttttttattgtaatcagtaatatttttctgtttaccaaaatattaattaagtaaggagacaggaaaggaggtactactaacattgtgagagcagaagaagatataataggtattttgccactaaagataggaactttacttaaggaacgtctgttaaaagaacagatatatgaaataagaattaagattggaaaacctattcttgtatattcaaaatatggtgagaacatagtaaattatgtaccaacaaaagaagatatgaaaagcttgatacagaaaatttctaattattcattatatgcttatgaagaagatataagacaggggtttattacaataaaaggtgggcataggataggtattgcaggagaatgtgttatggaaaagggtgaagttaagaccataagaaatatttcatcaataaacattagagtatgcagtgaagttataggatgttctgacaaattaataaaatatatatactctcaaaaagagaatagaatatttaacactataataatttctcctccaaagtgtggtaagacaacaatattaagggatatagctagaaatatttcaaatggaatgaattcaataggtctttatggacgcaaggtagctgttattgatgaaagaagtgaaattggagcatgtcattttggaatccctcaaaatgaccttggaatgcgtacagacatattagacaactgtcttaaaaaagaaggcatgattatggcaatacgaagtctttcgcctgaaatattaatatgtgatgaaattggtacaaagggtgatgttgaagctcttttaatggcttttaattcaggagtaaacataataacatcaattcatggttttacaattgaagatttatataaaagaaaggtttttaatgaacttttagataatggaataattgaaagagccattgtattgagttcaaggaaaggtgttggaacaattgaaaatatatatgaattgagagaaggtgagaagacatgcttaagttagttattgcttgtgcgcttttcagtatttgttcatatgtaggatttgaatatggagaaggctttaacagaagaatgatgcagcttagagagatactaaaaagtcttataatacttcaaaatgatattttatatggttcaacaccactaccagaagcatttgaaaacttttcatataaagttgaagagccaattcattcttttataaatggaataagggaaaaacttgtatctggaagtgttgaaagtgtttatgatggtgtggcagaggagtatagggagcttaaaggaaaatttagtttaaatgacaatgatataaagattttaggagatttttttaagtctcttggcgagtctggagtttttggtcaggaaagaattttttctctcgctattgaaggtataaggatgaatttaaaagatgctgaggatacagctaaaaagaatgttaagctgtatagatatttaggagtctgtgtaggaggaatgattacaatttttgtattatgattcataaacataatatatttttaatattaataattaacagcagtaattaggattgtaacagataaatttttctgaaaatttataatgcagctgtatagtcaatactttttaaaaattaatttatcagatatgttttagtcagaaagcgtaaaaaccatgcatagggggagaaaaaatgaatgatataagtattcttttaaagattggcggagctggaataattcttgttattcttgataaggttctgacaagcagtggaaaatccgatattgcagcaatcacaaatattgcaggagttgtaataatacttttgatgatagtttcaataataggagatctgttcagtacagtaaagaccatgtttattatgtagcaggtggtattatgttgattttaaaaattgtagggatggcttttttagcactatttttaattcttatgctaaaacagtctggaagtgcgttaggtgtgctattagctttggctgcaggagcattaatgattcttgttatatttgatccgcttaaggaaataatgacatttttgcagaccatgtcagataaagctaatattgatacagtatatataggaattgtcctgaaaattattggtatagcctatattgcaacctttgccagcactttatgtaaagatgcaaatgttgacagtctggcaacacaaattgattttgcaggaaagataatgattctagtattagctattcctattttaatggcagtattaaattctatattgcagataatgtgattaaaaccaatgaacatctaatgttttgaaaagcgaagaatatgaagagcagtaaatttcgtgtaagtaaatttaaaaggttgtgtattcaatatgacgaggataaaaaggttaacagtttttttaataagctttttggtaatttttacactatatgaaccagtttttctctcaggcaataatagatatgcttgtgcggaaaagaatacaaaagaatacacggttttaggagcttatgatgaaaaaaattcatatactcagaataatatggggactacagaagaaagtaatataaagacaaatgataataccaatgaaaaaacaaatgtaagtattgatgatattggcggcagtgcaaaggggcagatagaaacactatatgattatattaataagatgaaaacggatgtggagcttcttcaggggttagatccggtagattatattaaggcttttatttctaatggaaaaggaaatttatcatttgacacggtaatgaaggctgttttgagtctgtttttcaaagaagttagaagcgtacttgctcttgtgatatctatagttacaattgcaatattatgtgcacttctaaagaatcttcaggactcatttgcagatgaaagcatatcacaagttgcattttatgcttgttatgctcttgtcataatgattctttcaaagagctttattatttcaatatctgtagcacagggtgttataaatgatatttcaaattttatgaatgcactcttgcctatattggttacaatgattgcactggcaggaggaataacacaagctgctactttagatccatttattcttggggctgtaatatttataccaaagatatacacaaatataataataccaatgatacttatgggatttgttttagaatttgccaataatatctcagaagagcataagataactaatctatgcaagcttacaaaacaatgtatactatggttccagggaataatattaactgcatttattgccctgctcacaataagagggataacctctagtactatggatgcagtaactcttaaaacagctaagtttgcagtagataattttatacctatagttggaaagacattttcagatgcaataacgtctgttgccggttactcattaataataaagaatgcagtaagttcaattggtcttgttgtagtattgctgattttactttatccaataataaagctgattttaatgacatttatttataaaatatcatcagcattagtagagccagtaagtgattcaagaataacaaaatccttagaatgtgctggggactctatggttctcataatatcatgtgtgcttacagtaagccttatgttctttattttaattgcaattatggctcaggctggcagctatgtagtagggggctgataattttggaaaagttaaaagctctagtagctactctaacaacggttttaatatttataagtgcagtagaaattctcgctccagacaaaaagatgaaaaagtacatttcatttgttttaggtttgattttaataagtacaattttaaatccaattgtcgagtttattacaaatggagaaaatagtattcttcaaggaattgaaaattatgaaacagttttttcaaagaatgagaacaaaataaatacagatggatctacttcatttgaaagtacaagagatagtgaggatgcacgtaaaaaagcatttataagcaatttcaataaaaactgtgacagcatgcttaaaaataagttcgataatatgacttttaaaagtgaagttgattgtgatgttgattttaacaatgtaaagataaatgttaagaacttgaagataggtataaaagataaaaacgtacgaagaatagagaaagttgagattggaaaggaaaagaaagatacactcagagatgagtacaaagacgtaataagctatgcagcaagtgagtttgatatttcggaagataaaatagaagtgtatatgctggaggaataggaggaatgaatttatgagtatgaaaaaggtcacagatgatgttaaagattttctggaaaagaacagtaagataaaaaatcttattgtaatatgcttaattcttgtatttattctcattgcaatgaatgtggtgggcggaagcggtaagctgagtagcaaaataacatcaatatccagcggaagctcttctaaaagccaagaaaatgtgaatttagatacaagtaaagttattacagaagaagattacgaagaaaaacagaagacagatttaattaatatacttaaaaagatgaatggtgtaggtgatgttgatgtaatgataacatttgaaaatggtgagcagaaagttccggcttatgataagacagaacaaaaggcaactacagaagaaacagatacacagggaggaaaaagggttaataatcagaataacgataattcaaaagttgtaatgacacaaaatgatggcaaaaatgagccttttattttaacaacatacaagcctaagataataggtatagtaattgttgcagaaggcgctgaaaatagcaaaacaaaatatgaaattgaacaagcagtttcaaaattatataacttaagtttagataaggttaatgtatatagtatgaagaattagcatataattagatagataggaaatgggagggagttttattatgacaaagaaacaatgtgggattatttttacactacttgcactaatattgtgtacaggtgtacttgcagcaaaactaaataatggaggattaaatgatccaacagatttgagccaagttttatcatcagaaacagtaactaaggacaatagtgaaacagcggaagctgaaagtgatacacagactttaaatacacagaattatttttatgaagctagaagtcaaagagaacagcaggattcatctacaatacaatctttaaatgcgattatttctgatcaaaatacttctaaagaacaaaaagatgatgcaactaaacaattaactaaaaagactatggcaaaagataatgaaggaagaatagaattaaacataaaaaataaagggttcgaagatgcattatgtatgcttgaagataataaagcaaccgtaatagtaaaatcatctactggaatagaagaatctgatagcgttgcaattcaagagattgttcaagatgtttcaaatattaaagatgtaataattgaagttcaaaaataatatatcaaaaataatataattgtaaagttaaattttatttgttataatgaacataagattaggatgttttgttattacaaaaccgaggaggttcagatagcatggaagatataaatagagatgaaaatatcggaattgttaaaatttctgatgaagtagttagtgttatagctggaattgcagcacaagaagttgatggaatattagactgtcaaaatggtgtggcaggcaacttaacaaatatatttaagggtaaaaagagtgcagtaaaaggcactaaagtaactctagaagatgataaagccattatagatatgaatgtggctgttgagtatggaagaaagattaatgatttagcatctgcagtacaagaaaatgttaaaaagactgttgaagctatgactggattagaagtagattcagttaatatctgtgttcaaagcatttacttaccaaaagaagaaggaaatgaatctaaatagtttagttctcaccctctgaaatttcagagggtgtttaatttgaatggggtttaaaagatataaaaagtgtgtataatgttagatgtacataattaatatgacatttattttaggaggattcgatgaatagaaaattatctagggaaaaagctatggagttattttttgggatgacttgcagtaaagacacagtagaagaagcggtagaaactttcattgacaattatgaaggtgacataaaggaattagatcttacatatattaaaaaggcattaataggaattgaaaataataaagaagctatagacgaagcaatatcttcaaatcttcaaaactggaagattgacagaatttctaaagtgaatttaactattttaagacttgcagcttatgaaattttatttgatgaagaggttccaagaagtgttgcaataaatgaagcattagaaataacaagaaaatactcagatgaaaagagtgtttcatttgttaatggagtacttgataaaataaaataatattgaaatatatgtgtgatgaagaggaataattaattgaaaaaattcttcatggattgttttaattgtatttatagatgtgtagttacaatatatattaaaaaactcagagttggtaattttataatttatcaaacctgagtttttttataacttcagaattgaaatttggtaaatttaaatagtggacaatatataggggaaataattaatatagagaaatttttggaataaactatcaactgtataaattatcgtttttataattattatattttgaataaagttatataataattgttagaagtaaaatgagaaatgtatatatataaacaattattgaaaaaatataaaagtaaagttaaaatagacacatagagtaaagtatattcaaataagaatattataattttaaacgcaaatgagaaagtggggaattaataaaatggggcaattaataaacggaaaagaagtagcagcaaaggtaaaggaagaaatcaaaaattttgtagataatagaaaagaaaaaggtcttaagcttcctaaaatagcatcaattttagttggagaagatggcggttcaatatattatatgaacagtcaggaaaaagcagcagtagctcttggtgtaggatttttaagagttgaattaaaagaagaatctacagatgatgaagtaataaatacaattaaaaaattaaatgaagacgatagtgttcaaggaataatacttcaacttccattaccaaaacatttaaatgaaaagaaaataataagagaaatttcagttaaaaaagatatcgactgtcttacatttgaaagtcagggtaaactatatatgggtgaaccaggatttttaccatgtacaccaaattcagtagtaactttaataaagagtttaaatattgatttaaatgggaagaatgtagttgtactaggaagaagcaatattgtaggtaaaccagtagcacaactgttattaaatgaaaatgcaactgttacaatatgtcattcaagaactaaggatttgaaagaagtatgtaaaagagctgatatactggttgttgctattggtagaccaaaatttattgatgaaagttatgtaaatgaaaatgctgttgttatagatgttggtacatcacgttttgaaggaaagataacaggtgatgttgattttgacaaagttatagataaatgcagcgctttaacaccagttccaggtggagtaggagcattaacaactacgctactaataaaaaatgcatgtgaggctttaaaggaagatgaaaattaaaactttaaccgtatcagaagtaactaattatattaaacgagttttggacaatgactttattttaaataatctctctgtaaaaggggagatttctaatttaaagtatcatagcagtggacatatttacttttctcttaaagatgataaaggaaaagtaaactgtgttatgtttaaaggtaatgccagctttttaaagtttaagcttgaagaaggcatggaagtaataatatgtggaagagcatccatttatccagcgacaggatcttttcagatttattgtgatgaaattcaaaaagaaggtcagggagaattatttattaaatttgaaaaattaaaagagaagctatcaaaagaaggatattttgatgttgagaacaaaatgccaattcctgcatatcctaagagagtaggtgttgtaacatcgcctacaggagcagctatacgtgatataattaatgtatcaagaagaagaaatgactctatagatattgttttatatccagcaaaagttcaaggtgtaggtgcctataaagaagtgatggaaggtataaaatacttcaatatgaaaaacaatgttgatgtaataattgtaggacgaggaggcggttcaatagaggaactctggaattttaatgaagaggaacttgctatgactgtttatgattctcatattcctataatttcagcagtaggccacgaaatagattatactatttgtgactttgtaagtgattttcgtgcagcaactccgtctcaaggtgctgaaatagcagtaccattgaaaagtgaaatattaaacaatatagacaatttaagaaaaaatcttgatgataatattgaatataaaattaaaagctgtattaatgaaattaataatgctgaaagaatattaaaaatacactcaccattgagtcttattgcaaattcatatttagaagttgataaacttaaagaacgattgaattttgctataaaaacaaaactaaataaagaaaagaaaaatattgaacatttaaacaatcttctaattgcatataatccgactaaggttattgaaaagggatatgctataatagaggatgatgaaaacaatataataatttcaaaaaatcagttgaatgaagaaaaaaaattaaatataattcttaaagatggaaaagttaaagggaattttatccccttaaaataaggagtttaaaaatggccaaaaaagaaagttatgaagaaatgttatctaaacttcaggaaatactaagcggtcttgaaaatgatgagcttaaccttgaagattctatgaaatcttatgaaaatggagtaaagcttgttaataagatctataagacacttagcgtgtatgaaggaaagatttctatggttaaagacgaaaaagaagtggagtttaatgaagttgataatgataaataatttaaggaaagacataaatgattatttagataattatttcaaaaacaaaggtatatataacaaagtaatatatgatgcaagcggctatagcataaatataggaggaaagagaatacgtccaatattatttgctttatcttattatatttacaaaaatgagtataaaaatattttaccaatggcatgttcaatagagatgattcatacatattcgcttattcatgatgatcttccatgtatggatgatgatgacttaagaagaggaaagccaacaaatcataaagtctttggagaaaatattgctgtacttgcaggagataatctgcttaatgaagcaatgattttaatgatggattattctctaaagaatggaggaaactctttaaaagcagcttatgaaatagcatcttcagctggtgcagaaggaatgataggtggtcaggttgttgatgtaatatctgaaggaaagaaaatttctaaagatgaacttgagtatatgcacgcaaaaaagacaggagcgcttataagagcttcaattgttggtggtgcagtacttgcaggtgcatgtgaatctgatgtaaaaattttaagaacatatggagaaaaattaggtttagtatttcagattaaagatgatatactagatgttgtaggagatgctgatgttctaggcaaaaatacacatgcagatgaagaacatgacaaaactaattttataagtgtttatggattagataaatgtagagagttatgtaaaacaataagcgaggaatgtgtggagttgcttaaaacattaactgttgattcacaatgtttagtggatttaacatatgatcttttaaatagagaaagttagcagaggaaatgatattatgaaattaatagatactctagacttccctagagatattaagaaattaaccccaaaagatacagagatacttagtgatgaattgcgtgaatttttaatagaaagcgtttctaaaacaggaggtcatttagcatctaatctaggtgtagttgatcttaccttaagtttgtttaaggcttttgactttgaaaaggataaaatagtctgggatgtaggtcatcaaagttatgtatataaagttttaacaggaagaaaagatggttttaaaaatttaagacagtttaatggaatgagtggatttcctaagagaaatgaaagtaattatgattgttttgacacaggacatagcagcacttcaatttcagcagcactgggtatagcaagagcaagagatttgaaaagagagaattatcatgttattgcagtaataggtgatggtgcattaactggaggtatggctcttgaagcccttaatgatgttggatttagaaaaacaaaattaattgttgttttaaatgataatcagatgtcaatatcaacaaatgttggaggtctatctagatatcttaataaacttagaatggcaccaacatataataagctaaaaaatgaaattcatgactctttaaatcaatcatatataggcaaaaatattgctgttaagctttcgaaagttaaagatagcataaaacaacttgtagttccatcaatgctttttgaaaatatgggattaaaatatataggacctatagatggtcataacatagaagctatgactgaagtttttaaaattgctaaggattttgatggaccagtaataatacatactataactcaaaaaggaaaaggatatgcattagcagaaaagagtccaagtaaatatcacggagtaagtccttttgatttagaaagtggagagccaaaggttagtcataaaaatagttattcaaaagcatttggagagtcccttgcaaaaattgctagagaagataagagaattgtagcaataacagcagcaatgccagaaggaactggactaaaatgctttagtgaagaatttaaagaaagattttttgatgttggaatagcagaacagcacgcagtaacacttgcagcaggaatggcaagtaatggattaaagccggtctttgcagtatattcaacatttttacaaagaggatttgatcaggtaatacatgatgtatgtattcaaaatcttcctgtaatctttgcagtggacagagcaggaatcgttggtgaagatggtgaaacacatcaaggagtaatggatctttcatatttatctcttattcctaatataactattgcagcacctaagtgtcttgctgaggttgaagttcttcttagatgggctgttaataaaaattctccagttgcaataagatatccaagaggaggagacataatagacaacattcctcctataaaagaagtaaaagaaggcaagtgggagattgtaaataaaggatcgaagacatgtataatagcaacaggtaagatggtccagcatgcagtttatgcaaaggaaatgttatacgaacaaggcataaatccgactataataaatgctgtttttattaagcctattgataaaaatttaattaaagaaatatctgataaaggatataatatattaacaatagaagataacatacttaaaggcggccttggcagtgcagtaagagattatcttatggaaataggatacaaaggaaaaataaaatcattaggatatgatgataagtttattccacagggaaaagtagatatactttacaaagcatataaacttgactgcgaaagcattagagaatcaatattagaactttatgattaaaaggagaacataatggcagaaaaaaaagaaagacttgatatacttttagtagaaaaaggaataatcacttcaagagaaaaagctaaagcatgcataatggaaggtagagtttatgtcaatggccaaaaagttgataaggctggtgaaaaagtaggagttgacagtgatatagagtacagaggagataccttaaaatatgtaagtcgtggaggattaaaacttgaaaaagcaatggctacatgggacttaacattagatgataaggtatgtatggacattggagcttcaacaggaggctttacagactgtatgcttcaaaatggtgcagctaaggtttttgcagttgatgttggatatggacagtttgcgtggaaacttagaactgatgaaagagttgtatgcatggagagaacaaacataagatatgttactcctgaagatataaataatgatttattagattttgcatcaattgatgtgtcctttatatcattaaaaaagataatgccagcaactttaggtcttttaaaagatgatggtgaagtagtagctttaataaaacctcagtttgaagcaggaagagaaaaagttggtaaaaaaggtgttgtaagagaaataagcactcataaagaagtagttcatggaataatagactttttattagaacaggatcttaacgtacttggtgttggatattcaccaataaaaggacctgaaggtaacagagagtatcttgtttactttagtaaaaataaagataaggaaagcagttttgtgaaggaagatattgatgcagtggtagaagcatctcatgtagaaatctaacttcttttggaggggctatgagaaatattggtattgcaattaatccgtcaaaggataatgataataaaatcttaaatatggttataaataaaataaaagatgtattcaagataaaagaagttcatatttttaattcttatgatttagaaagacaaaatctcaaaagtattgaattgcttgttgtacttggaggagacggaacacttctaagtgcggcaaggtcagttaaagaagagtttaacggaattttgtttggaataaacatagggaatttaggctttttatcaagtatagagatatctgatatcgacactgcattgacaaaacttaaaaacaatgaatatgaaattcaggaaagaatgatgcttgagtgtgctggagagtttaagaatatagtagaatgtggactcatatgcaaaaaagaattaaaaaatattaaaggctgtgctgatatagatgattttaaaaaagaaaaattaaatgcttttaatgatgtagttcttgcaagaggtacactatcaagaatggtgaaatttaaaatatatgttgacggaaagctctattcatcttttaaaggtgatggacttattgttgcaacaccaactggatcaacggcatattctttttcagcagggggaccttttatctatcctgatttagaacttataaccataacaccgatatgtccacatacaaaaagcatgcagactatagtccttaaaggtgatagtattatagaaatatatgcagaaaatgaagaagaaaaaatatatttaacagttgatggacaaaaagcgatggaagttaatcaaaaatcatgcgttaaaatttataaaaaacaaaaaaatgttaaacttcttttgtttgatgattatgattatttcaaagttttgaggaataagattttaaataattctaaagaatgtgatggtgaggaattttgaaatcaaaaagacatacaaaaatattagagataattagctcaagagaaatagaaactcaggaagaacttgcagaagcactaaaaatggaaggctttgaggtaactcaagcaactgtttcaagagatataaaaaatcttaaattaataaagatgcagtcttcaagtggaaaatcaaaatatgctgtatctacaggcgagcagaaaaatataatagacagactaagcaatattcttgcaaatactgtattatctgtagaaaatgtagataaaatggttgttataaaaacaataacaggatctgcacctattacagcagaagctgtagataatttagaaagcgcagatatagcaggtacagtagcaggagataatacaatatttattttagtaagaactattgaaagtgctgaacttttagtgtctaaaataagaaagagaatgtcgtcataaggttaaggatgggatgaaatgttaattcaattaaatattaaaaattttgcgttaatagaagaaatgacaataaactttaaagaaggatttaatatactgtcaggagaaaccggcgcaggaaagtctattatgattgatgcaatagattttgtactgggcggaaagttttcaaaaagcctaataagaactggagaagacagaacatatgttgaagcattgtttactcttgatggttctaaagtctgtgaagtattggatgaacttgatattgaatatgatgatgtgcttataataagcagagaatcacatcaaagcgggaagaatttaattaaaattaacggaaaaagtttaattacatctcaattaaaaagagtcagagcaaagcttttagatattcatggtcagcatcagaatcaagaactactgcttagaagcagtcacatactttatttagatggatttatagataaaagtattgaagaacctttaaataaatatactgtccttagggaaagtttactacaagttagagaagatcttaaaagaattacaggtaatcaagatagagaaaagcttcttgattatttaaaattccagattgaagatattgaaaaggctaagcttaaagaaaatgaagaagacactttgagagaagaatataacattttagccaatgcagaaaaaattaatcatgcattagttgattcttataaattattaagcggacaagaagaatttagtgttatggattcactatctaaagtaatttcagaattatcaggtgtagaaaagcattttgaaaaaataaaaaagaataaagatgttatagaagaagctttttatacaatagaagaagcaactcgtgaaataagagatatggctgaagaaatagtttttgataatgatgcgttagaaagcataaattcaagaatttatgaaattaatcagtataaaaagaaatatggtccgacagttaaagacatacttgattatcttgaaaaaattaaaaaagaatacgatgaaataataaattcagaaaagataatcaatgaacttagagaaaaagaaaataatatattaaagtctatggaagaagcagcgattattctgcatgaattaagagtagaaaaaagtggtgctttagaagagaaaattttaaaagaacttgcgtttgtaggacttgaaaaatcaagaatgcagataagggttgaaagagaagaaaccttcaatgaaagaggttttgatgatgtatgttttcttatttctacaaatccaggagaaccattaatgcctcttgaaaaagttttatctggtggtgaactttcaagaattatgcttgcattaaaatgtgtttttgcagaaaaagatgaaattccaacacttatatttgacgaaattgacactggtataagtggagcagttgcacagagagttggagaaaaaatgtatcagctttcatgcactcatcaagttttatgtattacacatcttccacagatagcaatattatcagattatcattactttgtaactaaaaatgtagttgataacaagacttttacaagtataaaagttcttaaaattgaagaaaaagagctcgaaataagtaaaatgctgtctggaaatgatgttacagaagcaactttaaataatgtaaaagaaatgataagaataagtgaagaaaagaaaaaagaaattaaaaattaaatacatatacttataaaaactggtaaaaataaaatcatggatttccgtggttttattttttttgtaatttttacatagtaaattcattctaattaatataaattttatggaaaaataattggaataatatgaaaccccaataatctcaaagctttcgaccatgatagttggaagggagagcaagaaataaatttattttttattaaaaatttagtatgaggtaaattttttgtcttttataacattgttcttataggataatatgcttgtcttgtggggaaattaaaatcaagaagtaaaggaggagagaaatatgaagaaaaaatttttatgtttagttagtctgcttatgactccaatcctatttctaattttaattaccgcagtatgtctcattaagctgccagataaaatttacactaaaaatgatgaaacagtcccatcaattgctcctattggaaacacaataacaaaagttgatgatgattccaataaatacgaaataaaatttttgggaatgattccattaaaaagtgtagaagtagaaaaaataaaagatctcgagttatatcctggaggtgtacctattggtgttagagtaagtagcgaaggtgttcttgtcgtaggatattccgatatagaaatcaataatgaaaaagaagaaagcccaggtaaagtcggaggcttagaaattggagatgtaattctaaaaataaatggaatagaaatgcataattcaagagatttagttaaagcaataaaacaaagtgaaaaagatagtataaaagttgatattttaagacatggagaaaatataacaaaaatagtaactttgaaaaaagaaaataataaagactataaaattggattatggatacgagactcgacagcaggtgtaggaacaatgaccttttatgatgatacatcaaaaaaatttggagcattaggacatccaataacagattctgatacaaatgaaccatttttaataaaagatggtgatgtaattgaatcaagtatcataagcataagaaaaggagaaaaaggttctcctggagaattaaaaggaattttcataaatgaaagtaatccaacaggtgaaattgataaaaatacacaaagtggtatattcggtcaattaaacagtaatatacttcagaaatctgatattaaacgcttaaaagtaggatttagagatgaaattgttccaggaaaagctaagataataacaacaatcgatgaaaatggtccacaagaatatgaaatagaaattgaaaagttattaaatcaaaatgttgcaagttcgaaaagtatggttataaaagtaactgatccaagattattagagaaaacaggtggtatagttcaaggaatgagtggaagtcctattattcaaaataataaaattgtgggagctgtaactcatgttcttataaataaacctgacactggatatggtatatacatagaatggatgctgcaagatgcaggaataattaaataattttaataagagttgatttaaaaagttgttgtaaggataacaaatatttgaatcaactcttattattaacaaaaaaatgattatttatttgaagaaaggacaagaaaattatataatataatagagaaatatttgttaagtagagtgctaagtaactttctcaacaaaataatataagtattttttttcaaggtatttacttgtagcaaaaaaaagtgtataatttacaaatagtggaagataaatacattaaaaccataaaattaagaaataaatcttataaaccacatatagtagataaatatggtgagagaaatatataccctacaataaaagaggaatttgataaaatttatggaattattatcttgatgtaagcaaatggaaagttacaatatgtgtgtgttgataggggaaaacatataaaaagtgcattaatagttaaaggagagaaaaatatggaagattcaaaaatttcagtattaatagctgacgacaacaaggaattctgcagtatactaaatgactacttattaaatcaaaaagatattgtggttacggggattgcaaaagatggtagagaagctttagagctaattgttgaaagaaaaccagacttagttattcttgatatcataatgccacatcttgatggtttaggggtgttggaaaagctaaatactatggatttggaaaagacaccaagaataattatcttatcggctgttgggcaagataaaataactcaacaagcgattacattaggtgctgattattatacagtgaagccttttgacatggaagtatttacaaaaagaataagagaaatgtttaatagtgctccaacaatacaagaaagttcagcacaatctaacagggtttcttatccaacaacttcttcatatattcttacttcagaaccaaaatcaaaaacgcctgttgatcttgaaacagaaattacaaacataattcatgaaatcggtgtacctgctcatattaaaggatacatgtatttaagagaagcgatcacaatggtagtaaacgacatggaacttctttcagctgtaacaaaggaattatatccttcaatagctaagaaatataatacaacagcttcaagagtagaaagagcaatcagacatgctatagaagtagcttggggcagaggacaaatagaagcaatcaataaactatttggatatactgtgcataacgataagggcaagcctactaatagtgaatttatagcaattatcgcagataaattaagacttaaaaataaagtatcttaatcgcagtgatagtgtcaaagtttaaaataaaaagatagctaggacgacaaatgttatgtagatttcaacgttttatatctataaataaaatattgaattattagctaaacatcttttgtttatcagtttaagtactggtatgcaggaggtgtttttttaaatgtataggaatttatataaaatatgcgacgctgaaagcaagaaaaaatctagctttcagtgtcgttttatggtaaattagttaatcatataagtgaggttacattagtgaaatctggaataataaagaaaattttaagtgatcattggtagggttttttaaaattatatagtaagaagattagaaaaaacgtgaaaagagaagttgaaaaggtattgaaatgtaaagatataaggcatggatatattgaatttaaatgtgatgaatgcaacataagtaaaaaggttgggtttacttgtaaaagcaggttttgcacatcgtgtggtaagatctatactgacaaatgggtagataatatgcttggagaattaataaatgtgaggagtttacactaggaatagtaacggttatacatacttttaggagggatttaaaatggaatccacatgtacatatgatggttacagaaggtggaaaaggtaatatcacagaatggagacatataaaacattttgcttatgaagcattacggaaaagatagcagaaagttttacttgatgaaattatgaatattagaggagctgataaaagaatgagagcattaaagaataaattatataaagataatgataaaggtttttatgtacatgctaaaacagaaataaaatcagctaaaattgatgctaaatatgttggaagtggaagatatgtaggccgtccagctatagctgaatcgagaatactacattatgatgggaaaagtgtaacatataaatatactagacatgaagataataagaaaattattgaaaaagttcatgtgtatgaatttataaaaaattgataatacatataccaaagaaaaattttaaaatgataaggtattttggaatctattctagaacaaagaaaggataaaataattttataaaaatgttagatgataaaatattaagattgagaaagcctttgcataaatgggaatatagaatcctagcagcttttggagtaagtccatgtaattgtcctatgtaataagaaaataaaattttatgatatagtgtatggaaaatatggctctataagagaatatttaaaaaagaaaattttgaaagagacagaacaaaagctagaagaagcaatagaactgtatggaattacaaaaggaataatatatggtagaataaatccgacaacaacgtagttggagggaaaagagatgaacgaagaaattgtatatgtttgcacactgtgcaaaattaaagaagctatacctaaggaggttgtggaatactttgatgagatggatcaaagtaacgtagatgaaccaccttgtttttcatgcgaaaaatgtggcggagtgatgagaccacaagaatatcaaggagtatatggaaagacttataaatcataatatgaaaaccatagaacaaggctgtttctatggttttatttctaattttaaaatatttctccgaaggagcgtggcgcagccacttttttattaaaataaaatcgatattttataaactaactatataatagtatgttatgtgataaaatatgtttataaaaactaaaaatgggagaataatttgatgtatatagataagaaatatgaaaataagattagagaatgtttcaagtcacaacaagtagtaatttttattggtgcaggggtatcacaaaacttaggattaccatcttggagtgaatttgcatataagcatgttgatattctatataataataaaataattgattataaaaccaaggaattattatataaagataattatagaacagttatgtcattatgtaagaatgttatatcaaaaaatgaagaccttcaaaaaaagacattagaaatatataaaaagttgtttgaagtaaaaataataaatgaagaaagagaaattattaatattaaaaatttaaatgggttatctgatgatgaaattaataaagtaaaagagtatattagaaaaaagcaaataaaagaaaaaattaatgatccagatgggatatttaagaaattatatgatataaatgcaatttatataacaacaaattatgacgatgtttttgatatacttgctgaagaagctaatgaagatgaaattaagaatgtattcagtgaaagtaaaggaaagaatgaagaaaaaaaagtattttatcttgaagaagattttaattacaacttaaaaaataagcaaataagaaatggacaagtatatcatatacatggaagtattaataaaatagaggatatgattgtttctaatgaagactatattgtgagatattggaaggggaaaaattcatttaaagattttttaaaatatatttttgataactataacattatatttattggatatgggttagaagaattagaaatattaaattatatgtttgaaggggataagtctattatagataaatgtaataaaaaaagaatattgataactaatagctatgaaaacgaagaaaagggcaagattaatttattaaaagattattataaggataattacaatattgatatttgctgttatgacatgactgagcaaggatatagagaattaaagtgtgttgtagcacagatgtacgagataaaaaatgaaatagaaagtaaagagagaaggcttgaagaaactataaaattaatggagttgatataaattggaaagttcagataaagaaaaactattagataatttaatgtatataaaaagattacagagagccttttttatgaaaattaatggacaatattctgagtggtttgatttattgtgtaaaaagggatatttagatttttctagtggaaagatagatgaaatagcttgcattcaatatttattaagcgtaatagatgaaatagtaaagcacgaaaagttagaactgtttgaaaatgttattaataatatatttagaagcaattatgtagatgatttatttgaagaattgtcgtatatatatataaaattaggtgatatatgcaataatacattgcttgataatatatttgaacattcaaaaggaaatgagtctggccagtatattgtatttgataagattttttgttacatagtaaataaatcaggtttgaacaatgatttcaaaaaaacattagattatctttgcgatatacttaatgaaactaagaatagagatacaatgttaagttattacttttttgataaagatgatattatatcaaatgctataaaatattactttgaagattatgttgatataattttagaaaaatttgaaaaacaattcattttagaagaatactcaacagttatagatgaaaaaaatgtgaaaataaattatttaaataaatctaaaattgaagtttgtattgaagatacaaagcatgaaatcaattattcagataggtttgatttggaaacacagttagtaagtttaattaattctaatgataaaaatgaagtacgtgaaatgattgaaaatatgtttagtgattataattgcagctattcattagaaaacatggctagttatgcaaatggaataatgggggatgttatacgatatattctaaatattattgacagagctgaaggtgaaagccagttggaaagcttgttaaataaattgttcgagagtgattgcagtgtatataaaaagatagcacttaaattaataattgataaaactaataataaaataaataaatttttattagataaaatacattcaaagaacgccaatataaaatatattataagaaactatatttttgaaggagagcttaaacaattatttaaatccattaataggaaagatcttgattatttgcaagatgatttgatagaaattattgaaaaagggccatatattaaatacgaatggtatgatgagaattatattattagatggaagcaaaagagatatagggaactaactagttttgataaaattaaaaatatatataacaagttgaaaaaaataagtaatatagaagcagaattaacatttccatctggagtaacaagtggttttgtaaaacagctaagtaatataactgaaaaaaaagtattcgaaatgagtccacaagtactagttgattatatgaatatgtttgaccctgcaaattttcatagtaaacaggatttcgaagaatattcctatacaggagaagcagaagtaattgctgaagcaatagccaaaaaaccaagaaaacttttagatagtttagatttgtttataaaagttgataatcatatatacatttatatgattctgcttaaattggaagaaattataagcagtgggaaaggagatgcagaacaatattatgttttaataatagattattgtaataagtatctggataaaattttatcatattcacatgttaaagaagatattgtaaaagaaattagtatttctgcattaatcaaaagaatatttcatatagtatcttcaattttaaggaaaataaaaccggaggataatattgatattaagtcaatagatgagtttattagatattctaatgaatcagtaaaggataatgcatcatctatagaacaaaaagattcggattgtataacatatttaatcaattcagtgcaaggtgtatttagtattttgatattagattatatgttattacttaagaagtatgatgataggtacaaggacaaacttgatgaaataaaaaaagtttttactcagcgtataggtaattattgtgaagaaagtctaatattaattggatggagattttattacttttgtaatattgatagtgactggattgaagacatagtagaagggtatacaacaagtggaaaaataaaatattttatatatggttttgcaaattgcagagttatagaaaagaagtattatgaaaaatattatgaaataatagtagataacatatcatctgatttagaaaacttagatactcataaaaaactattagaatatttatgtattggaaatatcatgggttataactgcgataaaaaagaagattttgtggatagagttataaaagggagaacagatgcagacattaagtatattattaatcttttaagtaatattaagagatacaaatttataaatatagataatgcattggataaaatcttgtttatatgggaaaggatagttaactattataaagaaaataaggaagttttgagggcatgcttaagtatagttaagaattacaaaagtaaaaataatagagtattagatataattaaatgtatattgagatgtggggaatggcagagttcaccgtatagtaattatattagtagtaaagcattgtatgattatttaaatttattaattaagcagaaaataaattatgaaacaattcaagaaatattaattgattgtatagctggaagttgtgataatgaatatattgaaattatgagaactataaaagaaaatgatccagatgtatttaatcatataaaagaagagtggcttaaaaaaaatataaaatatagtgttattcaaaaatattttatgagcgaagtttaataaaagtttaattttatagagatagctaaggagaggaacaataacctcttcttttttattaataatttttaggaggaatcaattataataagtgaaaatgcataagtaagactagtagattatacagtatataggaggaagagtataaaggagaagagatataaatggtaaatatcgagattaaatcagataggcagtatggactgttaaatgatatagttgatttagatataatatggcaaatcaataactttgattatatagatgacgaaaaagatataatcgaagctatagaaaatctgaaatctttacatggaataaaaacacaattgttatatattggtgatgagatattgtatggagcattgggaataaatcatattcttaaatttgaaggtagagaagtattattgttatacgattctattgaacaacatttagaacaagtaaataaaatagaagagggattttcagtaccttatgatgatgaaaatattgtgtctacaggaatatttacaaatggtagtcctgtttataatgtttacaaaacagatttagtgtttttaagcaaatggagagaacagcttaagcaaagtgcaagtaaatataaaatgtcggatgaatataaggaatatgatgaaatagggattgtagagtattttggatttgaagaagatgtagattaagtgtaagctctctaagtgtaaaatacattttattgataatacaaaaacaaactttattttctagactataataaaccatattgaccaattaagagttatgatgataaactattagcagattaggtaaaacttgtgtgataacgactatgatatatctaccgattttagatgtaaattaaataagtattcatcaatgagcaagtttaatgtaagaactacattcactaaaggtgcgggaaaaatgtaaactaaggatgtgtaggattcatctttcaagaaaaaggagatataaatgaaaacaataattgataaactcaagatggcaaaggaagttggaattagagattatgaaaaactaaaagaaaaaactaatactaatcaaggtgaagagatgatagttcttgcaagtaggactcttaggtaaagaattatcggtgagataagacaagaagatactgatgaatatattggtattaataaggatggttgggtaatatatacgcatgatatagagtatttcgggtgtggagggattaaaattaaaaattcacatatttatgagaaagacgaggaatatattattagaatactagcagaatataatgaaaatgaatataattgctttatgactaaagtagataatatttgctaaatattggataaaactgtgggaagaatgtactctcatatgtacaatttgatatttcattattagttcatgatcacgttggaataatagtcttataagaataagtaatagaataatgcttgttaaataataaaaatcatagtatactagataaaaagtatatccaacaaactgatatactcaaagccaactgattattttgaaaattattgaaatatatcaggtataaaataataaaaattaagtcttaattttgctattacaatggtagtaaacgatatggaacttctttcagctgtaacaaaggaattatatccttcaatagctaagaagtacaacacaacagcttcaagagtagaaagagcaatcagacatgctatagaagtagcttggggcagaggacaaatagaagcaattaataaactatttggatatactgttcataacgataagggcaagcctactaatagtgaatttatagcaattatcgcagataaattaagacttaaaaataaagtatcttaatcgcagtgatagtgtcaaaatttaaaatgaaaagatagctaggacgacaaattttatgtggatttttacgttttatatctataaatataatattgaattatttaataaacacctgttgcagattagtgtatttactaatgcagcaggtgttttatttaaaataaaaaaatatatatacacaaatgaattatttaccatattacaggcatgtataacgccatagatgttataataaaaatataataattaattggtcaaaagagttatcaaacaggaggactaatatgtataagaattatatttttgatctttacggaacattagttgatattaatactgatgaagaaagttttgaattttggtacaagttatctatattttattctttcaaaggagcaaaatatacacctgaggatttaaaaattacttatgatagtaaagtaaaaaaactacaagaaagttttactaatactagatatccagattttcctttagaaaaaatttttaaggaattatatgaagataaagctgttgttccatctgatgaacttattgaaaatacggcacatgtttttagaactttatcaataaaatatttaaagctttatgatggagctatagaattattgagatgtttaaaagaaagtggtaaaaagatatacttattatctaatgctcaaaggatatttacatcatatgaaatgagagttttagatattgaaaagtactttgatgatatttttttctcatctgattataatatttgcaaaccagaaaaaacatttttcgatgctttgttaactaagcataatattaatgttaatgaaagtataatgattggaaacgattttatatgtgatatagatggagctaaaagtgtaggattatcttcattatacatacattctaatttgtcgccagaaataataggacatgttgatagcacatatactcttatggatatgaatttaagaaatgtaataaaaactataataaagaatgtataatatattttttcatatgtaaatgatattagaatttagataaatactatagaaaattaacatatcagattgtgcaattgcacaacaaatattattcaagtgtcatattgaaattttatatatgtgaatatataataggaataagtagaaagcagcgaagcttatgattatcataaggttcgcttatttttttacacatttaaagcaaaatatttgaaataattacaagcaatggtgttgtgtataagtatatttatatgtaatatcattgcttgtttttatatataagtacatttatttgcagtaaatgaaacgaagtcataaagaaagaaggggattcttatgaaaaaggtattaacaaaattagcagctgcattaactgtagcatcaatatgcatgatgtcatttacaggatgtagcgaaacagctgagacgagcagtggaggaagttctacaggaagtcagtcagatactatcaacttaggattcgtacttcccataacaggaagtgttcctaatttaggaagtgctatgaagaatggtgcagaactagccattgaagaaattaatgatcagggtggaatcaatggtaaaaaaattaaggctgttattgaagatgatgaaaataaaccagcaacagcaccaaatgcaattactaaattaatagatcaggataaagtagatgcagttttaggaacatatgcaagcagctgttcaatagcaatggctccaattgcaactgcaaataaaaaagtaatgctttctattggatctacaaatgcaaaggttacaacagaaggcggcgactatgtattccgtgcatgtttcatagatccattccaaggaaaaattgcagcagaatttgcatatgacgatttacaagcaaaacaagttgcacttttatatgatgttggaaaagactactgtgttggtatttcaagtacatttaaagatacattccaaaagttaggtggagaagtagcttatgaaggaaagtataacactggtgaaagtgatttcaaatcttacctaacagaaataggaaacaaaggtgtaaaagtacttttcatacctgatgattatgatgttgtcggattaattgcaaaacaaattaaagaacttggtttaaatattcaacttttaggtagtgattcatggtcagatccagggcttatggcagttggtggagatgcagttgaaggcgcttactttacagatcacgtatctattaaatcagaaaatttaaaaacatttgtatctaactataagaataaatatggacaagatccaggtgcattctcagtacttgcatatgattcagtttatattatggcaacagcaattaagaatgctggaagcactgactcagatgcaataaaagatgcgttaaagaagttagatgaaaactgtggaactactcactataaattcgatgaaaatagagatccaataaagagtgttgtaatcaacaaagtttctaatggacaatttgagttcgtaaaggaaattcaacccaaatagtaattatataaaatatgttgtaaagcctgcatttaggatgaaggtataatgcaggcttttgatttttcattatagagggaggcggaaaatatgaatactttacttcagcagatcgtaaatggagtctgtcagggaagtgtttatgcacttatagcaataggatatacaatggtttatggaattataaaattaataaattttgcacactgcgatatttatatgtttggtgcttatgcaggatattttgcagtttcagtattaagatttggttttacagaaacacttgtatttgcaatggtagcatgtgctgcattaggaatgcttatagaaagagtagcctataaaccattgcgtaattcaccaaaggttacattattcataacaactatgggtgttgaattattattacaaaatcttataaagacagacatgcttgcaggacctaacacaaaatcatttccagaaataatacctttaaaatcatacagcattggaagtgttattataagtaactatcagattatagcaatccttacaacggttatcttttgtatattactacaatttataataaagaaaacaagcgtaggaagagctatgagagctacatcatatgatatggatgcagcatctttaatgggtattaatacaaataaggttatttcacttacttttgcattaggttcattattagcaggaactgctggagtacttgtaggacttttatatccaaaattaacaccagccatgggagttatgccaggattaaaatcattcgtagcggccgttcttggtggtatcggaataataccaggtgctatggtaggtggaattattatgggacttattgaaactttgtctaaagtttatatcagttctggtttatcagatgccattgcattttcaatattaataataattcttttagtaaaaccaactggattatttggtaaaaattcaagagagaaagtgtaggtgagaatatatggatattaatgttaataaagcagagttaaatagaaatataaaaaagacctacattagatatgcgattactacaggagttttattaataatatactggatggtattattacttattcaaaaaggaataatggataactatacattaagaattgtaaaacagataggtatatttatgatagcagcacttggattaaatttaatattaggatttactggacagcttacaatgggacacgctgcatttatgtctattggtgcatatggttcagcagtaatgactcagaatttcaatatgccttttgcagtttctttagttatgggaacagttttatcatgtatcatggcagcattaattggttatccaattttaagattaaaaggtgactaccttgcaatatgtacccttggatttggtgaaattgttaaggttattattcagaatatagattatgttggtggtgcaagagggatgacaagcatacctacaaagtcaagtttattgattattttcttatgtgtagcaggatgttatgcacttcttaaaaatcttctccactcatcaaaaggtagagctataatgtcagttcgtgaagatgaaattgccgcagaagcaatgggaataaatactacaaagtataaaatgatggcttttattataggaagtggtatggctggacttgctggaggattatatgctcatttcaatacattcattgaccctgtaacatttaatttctcaaaatcttttgaattgattacgtatgttgtacttggtggaatgggaagtatatcaggaacagtattaggtacatcaatattaatattccttcctgaatcattacgtggattaagtgatgtattaaaggaaaatcgtatgcttatatatgcatttttacttgttgtaatgatgatattcagaccagatggaattttaggatctagagagataactgtaaaaggaataaaaacatcaataaagaaattactatcgaagaagaattcttctaataaatcagataaatcagaaacaaaggcaggtgtgtaggtatggctttattaaatgtggagaatctaacaataaaatttggaggacttacagcagtatctgaagttaatatggaaattggagaacaaaaacttgtaggactgataggacctaatggagcaggaaagacaactttgtttaacatgcttacaggagtatataaacctacatacggcaaaatagaatttgacaatgaaagaatagatggaattaaaccctatgatatagcatctaaaagaatttcaagaacatttcaaaatattcgtttgttcaaagattttactgttttagataacgtaatgacaagttttgattttcagacaaagacaactttacttggatctattttacacacaccacaccagataattgaagaagaaaaaatgagagaagaagcaataaattatctaaagattatgaaattagatcataaatgtaatgaatttgcaaaaaatttatcatatggtgaacaaagaagattggaaatagcaagagctcttgcaataaaacctaaacttttattgcttgatgaaccagcagctggaatgaatccacaggagactaaagaacttacagaaatgataagatggataaaggatgaatttaagatttctgtactgcttatagagcatgatatgaaattggttatgaatgtatgtgaatatatttatgtattatcctttggacaaattattgccaatggagttccagaagaaatacagaagaatcctaaggtaatagaagcgtatcttggaaagggggcggtataatatgcttaaaatagaaaatataaatgtatattatggtgcaatacatgcaattcatgatttgaatattgaagtaaatgatggtgaaattgttacacttattggagcaaatggagcaggaaaaacttctactttaagagctataagtggtttaaatccagtaaaaagtggagttataagctatgatggaaaagtaataagtaatattccacctcataagattgtatcatcaggaataagtcaggtaccagaaggcagacgtgtttttggagatcagacatgtgaggaaaatctgcttctaggtgcttatttaaaaaaggataaaaagcagattaatgaaaccatggaaaaagtttttacatggtttccacgtattaaagaaagaagaaatcaattagcagggacactttcaggtggtgaacagcagatgcttgcaattggacgttcattaatggcatcacctaaattgttacttcttgatgagccttcaatggggcttgcgcctatagttgttgaagaaatatttgagatcataaagagtataagaaaagaaaatactacaattcttcttgtggaacaaaatgcaaatgcagctcttcagattgcagatcgtggatatgtagtggaaacaggaaatatagtattagaaggacgtgctattgatctgcttcatgatgatgcagtaagaaaagcatatcttggtgattaatataaatttaagggggagaataatatggaacgatttgtaatagcaattacaagacgtgcaggaagtggagggacaacaattggtgaaatgcttgctgatgagtttagtataaatttatatgacaaaaaacttctaagaatagcatcagaagatagtggaattaatgaagctatctttcaaaatgcagatgaaagagtgaaaaatagcatattatatcgtgtatcaaaaaaagtatataaaggagagttaatacctcctgaaagtgataattttgtatctgatgaaaatttatttaattatcaagcaaaagttttacgagaactttcagaaagagagtcttttattgtcattggaagaggggctgactatatattaaaagacaaaccaaatgtatttaaaatatttttatatgcatcagaggaattttgtattgaacatgaaatgagtcatttgtgtacagatagaaaaggtgcaataaaatatataaagaaatgggataattatagaagtgaatattatatgtatcatactgggaaagagtgggaaaaaatgtctaattatgatttgtgtataaatactggagagttaggaattgaaaaaagtgtaaaatatataaaagagtatattaaattaagaatggaaaccttataattagaacattatttttgaaagtaaattattatgtaaagttctctataaacagtaggatttattatataaaattcattgaaatttataagatgctgttcaatcaatgtcagaaaagacggatgattgaacagcattttattttatgtaaaaaaaatagtagataatattacatagttatattaataagatgaataaattatggatattaaacatagtattaattagagtaacagaaggaggaataagagatgaatatttcaggtaagaaagtgaatataggttttaacagcagaaagggttacttttttattgtacttataatgttttgcttgggactgtcttttggactttatacagtaaaatatatgggaccagcagataaaaacgatttgataaattattttaccagttttgctaattctttaggaaatgatcaaataaattatggaagtttactagttgaggttgtgaaaaaaaatgtaatcattattttacctatatttctaattgggttaactttttttggtgggcctgtaatattaattattgatttattaaaaggcttcatactagggtatactttttcattcatggctactgtatttcaaggtaaaggatttggactagctatgataagtattattcctcaaaatctaatttacattccatgcattattggattaagcataattggtctttcaatgtctactgaaagtttcaaaagaaggttctttaagaaaaacaaaggtgatagtctattttctgaagggatagtaaaaaagctggctgtaattgcagtattgtttatagctggaatattggtagaaacttatatatcaccaatgttaataaaatttgtggttacaaaattctatttgtaaattcatattagaacatatgaagaatataagcagagagtgttttagttagtttgtcgaatgctaatcagaatcaatggtataggagagaacaatgataaatagtataaataattacaaggattatttgttagagagtggtaaaagtgaaaatactatatatgcatatgtaacagatgtaactctctatttaaaatttttaaatagaaaaaaggttgatatatataagagtgataatcttacagtggcttcttacattcaaaatcttttaaatcaggggaaatctgaaagatctataaatagaatagtaataagcttacgtaatttctattcatatcttaaaagtcaatcacttatacaagaggtacctaaaatagaatataaaagttctaaaaacaatagaaaactgccacaaatattaaccattgaagaagtagacaaaatcataagaattgtagaaaaagattgtccgaaggggataagagataatgcattgttggaattaatgtatgctacaggaatgaaagtgtccgagcttattaatttgaatgttgaagatgtcaatttggaattgaattttgttagatgtacggataataaacattatgaaagaataattccaattggaagaagtgcttgcaaagccttatcagaatatttgagcataagatataaaattgctcaatgtggagtatccaatctttttgttaatttaaacggaaataagttaacaagacagggcatatggagaatagttaaggaatattcaagaaaagcaggaattgataaggatgtaaaccttaataccttcagacattcttttgcagttcatcttcttcaaaatggagctaatgtaagagcagttcaaaaacttcttggtaatcaggtattaacatatatggacacttactacgagataataaataacgataaaatcaattacatttatatgcatacacatccaagagcttagcaaaatcaagaaaaaaacaaatagcttgcaggttccggtcagttgccaccaaaagaaatttggtggcaatttttatgttattatattttcaaatataagtaggataagtttgagaatacctgttataatattagtattactttttattattttataaaaatactgaatataatagtttataaggggaaataaaaaatggtaagaagatatttagtcgtaatggattatgaggatagtataggagatagacacatatcaaatgatgttatgaattgggaaggagataaaccagttctatctgtggatgatattagagaaatagaagaaatgtacgaaagagaaaattattggagaaatgtaataataacgaatttagtatatttaggagaggtttagtaatgaagaaaaaaatatgtatactagtagcaagtatattttttatgactcttgtaggatttagtggaattacagcttatgcaaagtcatcatctagtcgtagcagtagtcactcaagcagccgttctagtggctcaaaaagcagttcttcaccaagtagcagtaaatcatctggaagttcaagttctagcaaaccatccagtggcagtacaagtacaaaaaatagtagtaacacatcaccaagttcaactaaatcaagtagttctagtagttcaagcaatagtagtaagtcatcaagttcaagtagtagtagtagtaaaacatctagttcatcaagcagcagttcacctaaatcaagctcagggacaactagctcatcaagtaaaaattttaatggttcaattcctgatagctatgcatctcgttctgtaagtaataattattattataatagtgggagcagatggagtaatttattgagcaactatatgctttttagaatgttaactcctaataatagagtttatgtagatagctatggaaatacaagttatgcaccagcttataatggatttagatcatgtatcgctgatataattacatttttagttataataattataatatttgtattagttagaaaatttagaaaaagaaataggtaacaatatacattttaatagaaaatacatagaaaaagagtataatagtaattggggtaattataagttatgccaattactattatgtatttttgtacaaaggaataaattttgtataaagaaaacagaagaaatattatgttttatgaagggggaaataaatattatgaacaagaggactttagatatagctataatgtccataatgttatttgttagtacacttattccgagtcttttaaactggtctgtaggcggggctgcagcagttgcagtatgtgcttgtgttatatcaggaatttacttaatttcaacatcatcaaaggaaaaagaggacaagacagttcagattaaggaagaggtaaatgatgaccctactaatgaaattaagcatgagaatgaagatattatacattttaatgaaaacaatatcataaattcagatgaaattaaaactttagcagagtcacaagagaaatcaatgcacagcattaatgaaagtttattaaaggtgaatgataatgtcactaaaattgaaagtgaagttaaagaattagataatgtatgtactaaagcatctgatgatagcatgaaattagcagaagccatatgcaagactatgtatcttgtaagtgttggaagtgaaaatatgactaatatggatacatcaataaagaaaattggtgaagcaaatacacagcttgacgaatcaatcaaggctgcaaataactctactaaggaagcaattgatattattcatctaattggaagtattgcaacacaaacaaatcttcttgctcttaatgcggcaattgaagcggctagagctggagaagctggtaaaggattttcggtggtagcatcagaaataagaaagcttgctgatgatgttaaaaatgctgtaaacagtgttgatgcaataattaatgatattacagccgcaattgagatgataacaagcaatgccaatgaaagtggagaattaattaaggaaagtataactaatgttgcaacaacagaagaaacattccagtcaatagttactgaagttggagaaatagatggaaatgcaaatataattgcagaattaagtacaagctgtcagaatctttcaaatgcagtatcaggcatgacaagtgaacaattaaattttgtaaacaatacattagatgaattaaaaaatgctctaaatataaataaagatataataaatgagttataacagctattaaacatattttataaatctttgttaaagtttaggtatcttatggtgtttattgtatatgagatataaattataatatataaagcaagttgaactataaaaatacttaaacttgctttttattatacacttagacaaataaactatgattcataatattttagaaatttattagatttatagaattatttgaatgaactaaaaataattacaaatattccattatttgaagtataatagtattgaaaggatatatataataaaggtggtagaaaaagtaataggattgagaatgggaggaaagtttatgaaaaaaactaataaaaataaagtattaggagtttcattggcagcgcttgcagcagttgggggacttttatactgaagaataaatggaagaaaataaagaaacaaaatgaaattgagagtagtatatatgtaacaggaagagtacgaaaactaggttctttatatttaaataacataaagcaggatattctttctcagcagttaaattgtgaagatgtaatttcttatgatggtggtgcaattgagataagagatgctgataaaaatgataacaataaaatttcatgggtagaaataaatgaagatggtaaaaagcttcttatatgtgatagaaatttaataataggaatatcatggagtgaacttgataaccagaatcttgcttatggaaaaattattagacttggtggcaaaaagtacttgttgagacttttaacaggatcaccaaatgaaatggaagaaaaccctagtgaatgggataagtatatattaaatttaaatgaaattgatggattgccagtttctacagatgaagataaaaataatacaatagaagaggaagatggagacaaagaaaaaggcgaaaacaatcaattatggcattggagcagctgttgtagttttacacaaagtgaatacgggaaaaataataagttctgcataataagaggtttgtactcaacaacttataataattactgtgacaaagatataacttatgaaacagtaggatatagacctgtattagaattgatggaataaaaataacaggatacatatactaagataaatatgtatcctgttattttatttaaaatttataaaacacttaattagcctgttttacgacattgtcttctgaataattaggagtgcatataatgcctcttttttcatcaattttacttactatataaatagctagtaatgccattaaaaatccaggaataatttcataaagttgaaaaattgaactactgaaatgtacttttaaaataggccagaatcctgatgttattcctccggcaatcatacctgcaactgcaccatttcttgtcatcttgttccagaaaagtgaaagaattataactggtccaaaggcacatccaaatccagcccatgcatatgacacaagttttaacactgaactatcagggttaagggctatgataaatgcaataactgaaactacaagtacagtcagacgacttactcttacaagttctttatcagaagcatgtggttttaaaattgatctgtagaagtcttcagatactgttgatgatgttacaagaagctgtgaatcagcagtgctcataattgctgcaagaattgcagataacagtattcctgtaagtagtaatggtacacatttatgtacaagtaaaataaaaattgtttcagcatcagcaccacttaaatctgggaaataataatgtccaacaagtcctattgcagtagaagctgtaagagtaaggataacccatacagttgcaatttttcttgaaattttaatttcctcaggattttctattgccatgaactttgtaagtatatgaggttgtccaaaatatccaagcccccatgcaagtgatgatataattccaataaaagccataccaaaagttccagaagtagaaccagtaaggtgttcaatgttaaaaggatttaagagtgatgcatcaatagatgttgaaatactgcttaaaccacctgcctcaacaacaaccattacaggaagaattataagagtaaagaacattaataatccttgaattatatctgtataacaaactgccataaatccacctagataggtatagcttacaacaacaatagcacagattattacagaaacaatatatggtgtaccaaaaacagttgtaaaaagttttcctccagatacaaaacctgatgcagtatatggaagaaagaataaaataatgaaaattgacgatgcaatttttaatattcttgatttatctccaaatctgttttcaagatatgaaggtatagtaatagaatcagaaaatttctgagtatcaattcttaatttctttgcgattattttccaatttagatatgtaccaatagctaatccaccagccatccatacagaaccagataatccagtcaaaaaggctgcaccaggaagtccaagaagaagccagccactcatgtcagaagcctgagcgcttatagatgtcccccaatatccaagctttcttccccctaatgtataatctgataaatttttagtacgtacatagaagtaccatcctattagaagcataacaaataaatataatgtgaaggttatgcctataattagtttttgattcataatttttcccccttttttatgcttataaaattttatcaaaaaatagccgctatggcaaataaaatgattaattttaataggaaaaattaataaatgtttaataattatcttgtttatatatggtcgtttattgtatcaatttgaaaaaatatgcatataatggttatcgtgaaaaaagatgaaaaacatattaataaggattaataaacaccaaaatatgtgtatgaatggagatgaggatatgataagtattgaaaaattaaaagaacaagatagtgaattaatggacatatggaaaggtaattatgaaaatgagcataacattaaagggttattaaatatgacaaaaaatactggcgagaaaaaataatgggatgcagcaattgtcaatattggataataaataatggtggaattaaaattggtgttgtagatataaatcatatagatgatgatggatgtgttttagaatattatattggagatattcattttagaggaagaaatataacttcatcaattttatggaatatgtataattatctattcgatgatctaaaaatgaaatatgcaattactgttgtttcagaaaatgatgaaaaaaatcttaacacccatcttgcaatgggatgtgatataaaaggacgttttaaagagaacgaacataggaatgagaaatttaatgatatgatttatgtattgatgaaaagtgaaaaatggaataatataaaaggtggatttgattttgaacaaatttctatagaaaaaatataagtgacaaaagaaaggggtaatatgaataaaaagagaaaagtagcaattattttagcatcagtagcagttgtaatttgttcagcagcatttatatattctgagaaaaataagattaaaagtgcagtgcaaaattcatcagataaagagcctagtccagaaaatatagaggatatacctccatcaattatagataatgtagctccagatgtagaacaaaagtttaaagctgaagccaaggattttgaggttcatgataaagatggaaatgagataagactttcagattataaaggacagtatgtgattttaaatttctggaacagtagctgtgcctcatgtacaaaacaacttccatattttgaagaagcaataaaaaaatatgaaggacaagtaacatttttaatgattaatattgtagatggagagagtgaaacagtaggaagtgctcttaaatatttaaaagataataatattaacatcaatactacatttgatgatcattatgatgttagaatagattataaaatcgcaactcttccaagaacaatttttattgataaaaatgggttgattcaaaaagatgcaaaatttgaattgaatgaagagacccttgaaacgcagatacaaaatttaattaatagtgaaaattaaataataatatttaaaaatattaggactgctttaaataaatttaaaattcaggcagtccttaaaatataaaaaataactcattacaaaaggaggaaaagatggattttaacaaattgagtaacagaacaaaaggaataatttttattataatgtcagcttttggatttgctatgatgtcagcatttataaaactttctggagacctgccatcatttcaaaaaacattttttagaaatagtatttctgtaatagttgctcttacattaatagtaaagaataagggaagcttttttggaaaaaaagataatcaaaaattacttatattaagatcaacctttggaacaataggaatacttttaaattattatgcaatagataggcttgttttatcagatgcaaacatgcttaataagctaagcccattttttgttataatattttcagcaatttttttaaaggaaaaaataaaacctaatcagttttttgcattagcagtagcatttttaggagcattgtttataataaagccttcatttagctttgaaatgattccagcacttgcagggacattaggtggaataagcgctgcagctgcatatacctgtgtaaggtctttaggaggaaaggaaaagcccgatactatagtattttatttttcacttttttctagtattgttaccctaccattaatgcttatttcatataagccaatgtcaataattcagtttacatatttaattcttgcaggtatttttgccagtcttggtcagtttggaataacttttgcatacaaatttgcgccaggcaaagaaatatcaatttttgattatacaaatataattttttcagctattataagtttatgtttatttggcgtgttaccagattatttaagtgtaataggatatcttataatatttggttcatcactatatatgtttatcaataataagaagcttgataaagaacagaataataaataattttaaagataaaacaataagcctgttttatattacacaaatactgtgaatataaaatgggcttattatattttgcacaataatatgaggataaatgaaaatgtatctcaaataaaaattattttcagaaaaatcttgacaaaagtactagggtattataatatactaattgagaatagttttcaaatagaagggggacaaaaaaatgaaaatagtatattggtcaggaacaggtaatacagaagcaatggctgaaggaattgccaaaggtataaaagaaagtggaaaagaggcagaattagttaatgtaagtaatgttaatatagaagaattattaaaagaagatgtacttatattaggatgtcctgcaatgggtgatgaagttcttgaagaaggtgaatttgaaccatttatagaagaaataagcggaaagatttcaggaaagaaagcagctttatttgggtcatatggatggggagatggtcagtggatgagagaatttgaagaacgaatgattaattatggatgcacaattactttagattgtttaataaatcagaatgaagctgatgaaaatgagtgcatagaatttggtaagaaaatagctttattataatatgacaaggtggatgattttattatgaagtatctggatttttataaacgattaaattcaatggaaaataaagaatatatagaaaattttctagtatataaaacgtcatgggtaattgcaggagttaagccagcagttacgattggttttaaaaagaaagatgaaaaaatatatgaaaactggaatctatatggtaaagattttttagcagacataaacttgaaatatatagaacttagagaaaatgatgattctataattttaatgatttatgatgaagaagtacttacaagagaattaaacaaacaagaacaaatagattttcttattaatcttggatatccagagcaaattgaaattaatcaatatgtaaaaacattaaaagatagatatgaaaaatatcattgtccacatgaactagggttatttttaggaataccttttgaagatgttaaagattttatggaatgtactactaagaaatgtcttctttgtggatattggaaagtatataataattctgatgaagcaaaaatgatattcaatcaatatgatgaggtaaaacattatacaataaaaaatatgcttgaaggaaactcatcgcggattttagtatcaagcataaaagactccttttacaataattatatctgcatatagactccacacaccttatgcaggtaaaaaataaatcggtaaagtaataacgtattaaatagatgataagatttgttcttgacctccacacaacaagaataaatcaatatattagacgcatataaaatattaattcagtcctacacacactgaattaacttctttcaaatagaaaaataatacattttaggcacactattatataaatatcatgttgatttagtagatacatatcataaaattatcataagacctgaaaggatttttattctttcaggtcattttaaatttcatcacaaaattgacttgtattaactttttttacattatgcaataattgaagtataatttatgttatagaatagtcaaattatgaaataataatataaaaggattatatacaggaaaggatgtgaacgatatagggatggtattcaataaactgtttcaaatcgataaagttagtgaatcagttggcaatgtaaattatagagaagctgtaagagcaataataataaaagataaaaaaatattaatggttcactccaaaaataaagattataagtttcccggcggaggaataaaaaaaggtgagggaaagattgaagctttaaaaagggagattgaagaagaaacaggctatgttgccaaaagaattggtaaacaaattggcatggtcactgaaagaagcaaagacaaatatgttcataacagaatatttaaaatgatttcatattattatatagctgaagttacggatataattagagaacagaagcttgacgcatatgaagcaaaattagagttcaaacctgtatgggttgacataaaagaagcaatagaaaataacactaaaataataaattcaaatgatgaaaataaagctaactggattgaaagagagacttatgtattaaaagaaatatacaaaaatatatcaagtataatatagagtatatattttaattaacaagtatcggttcataaaaaatataaatttggggctataatttgtgacttgtatggttacaatagatatatatgttaaagaacttagtgaatttatggtctagtaaaatttttaaaattgtattatataaattggacgagtttcattatataggaaatagcataaggctgtgatttttcacagcctcatgctatttccaaattattatttagaacataaacgatcttgaacatccattaaagcctctccaaatctttggaaatggactatttctctttctcttaagaattttaatacatcttttatatcttgatcatcagttaattttattaaattctcataagtagctctcgctttttgttcagcagccatatcttcatgcaaatctgctactggatcaccttttgcttgaatataagttgctgtccatggatttgctaaagttatcaaaatacttaatttaatgggtattaaatattatttccacattattgttatcactgtcccatacagcacttttaataagtgtttgaattagaaatcttttttgagcagtatcatctatatattcaattgtatcagagaagctatttagtacattaataatattttttatatcaatattagtttttttatcatgtgactgttccagttctatagtttcaagatgttttttcagacggacaatatttttatcaagaaggtttatttcattcataagtctgtcagatactgttgatgaagcagatttagtaagctgtttaataagattatccattgaaactttattttcatgtatctcatattctatgctagaaatttggttgtttttaaaatcacagcagatattatctattgaatctctcaaagttttcataagagctgtcttatcatggatttttagttttctagttaatattttatcaagtttatcaaccctaatattttttgtagtacatttattcaaatatttattttgttttcctgaacatacataatattcataaggtatattatttttattttttccagaaaattttacaatcatatttgaaccacactttttgcattttaatattccagaaaatagtgaatgattttttccagttcctattcttggcatttttgatttgttattatcaagctggtattggactttgagccagttatcagaagttattattcctttatgattggaaactgctacaatccattgattagaatctgcagatatatttttttgattacttttattataagtaatatatccatttccattaggagatccaaatacattcaatcctttttttataagatattcgtgagatttatcatctgatattacataaagaggattacgaagcattcttctaatttgtgtaagatcaaaacttccaccatttttcccaattattgaatttacattaagaagtcgtgtgacttggcgtatagagtgagtcttaatataataagaataaacaaagttaacagtttcaagctcttttttattaggagaaagaatagaaaattccttttctttaaaatcgctaatataagtttttctggctatattaaatccataaggaatatttcctccaagccatcttccggattttgcaagttgaatcatgttgtctcgaactctttctgcaattgtttctctttcaagttgtgcaaaaacagatgcaatataaatcatagctcttccaagaggagtactcgtatcaaatctttcttttatacttatgaagtttacattatatttttgaagaagttcaagggtagatgagaagtcagcaacatttcttgagatacggtcaagtctatagcatataagagtatcaattttctttttctttatatcatcaatcatatgttgaaattctggtcggtttgtattttttccactgaaaccctcatcttcatatattatatattccaaattattgccactattaacatacgtgttgcagtaattcttacatagttctatctggttttcaatagattctcctttgcctgtaaaaacagatttacgtgaatatatagctatttttatcattgtgtcagctccttattaacaaattacattcttgattaagcataataagatgcgttaattgaagaactatccatattaatttctactttatatatatgtaagaaataatgattaactgaactaaattaatttactttaattgtagatgaagaacacaatttaaaagagtgaatagtatataaatgagaactactattcattttggagaaattttttatgaaaaaggatattacagtcactattactgaggaaataagtgaagaattacttgaaaagtattataaacagttatggaatgctttaaaagatcaatttggaaataaaaatttaaaagaattttacattgaattgtgtaaagatcagtaaaggaaagtagaacaaaacaattcttatctaatgtacattttaaatagatgtgtatgctttataaattgattaccatacaaagtaactaaaaagtaactgattagtaactaaaaagtgcctaattgttcaatggaatcactactgataaaataaattcaagtcacaaataattagataatttttagagacaatatatattgtaatttgaagttgaagaagtaaccttaaaaatcacattagggaggataaaaatatgagcgaaagatatgatatagcgataataggaagtggtccagcaggactttcagctgcccttaatgcaaaaataagaaataaatcattcataatttttgggagcaagactttgagtccaaaagttgaaaaagcaccaaagataaataactatctaggatttccaaattcaaatggtatgaagcttggtgaagcatttaaagaacacattgatgcaatgggaatagaaataacagaggaaagagttaactcagtttattccatgggagattattttaatattatggtaaatgataagatgtatgaatcaaaaactgtaatagtagcaacaggtgttgaattttcaaggccattagagggagaagttgaatttttaggtaaaggagttggatactgtgcaacatgtgatgcacctttatacaaaggaaaaacagtagttatagtagcatcaagcaaagaaggagaacatgaagcagattttgtaagtgaacttgcatcaaaagtgtattatgtaccattatacaaaggtgagtataacttaaacgaaaaaattgaaattgttaatgataaacctttaaagattttaggagaagatagcgtaaaaaaagtggtatttaaagaacgtgaaattgaaactgatggagtatttttattaaaagatgcaattccaccagcacagttagttccaggtatagaagatgaagagggacatattaagtgtgatagatcaatgagaacaaatataaaaggatgttttgcagcaggagattgtgttggtaagccatatcaatatattaagtctgctggagaagggaatattgcatcattaagcgcagtttcttatttagatagcaataaataagttgaaagtaattctataaaaaatatcaattaaggcagtagtaacttaaaagtgcctaattgttgaaataaatttaaaaacatataataaaaacaagcaaaaaacaaaagtattcggaggtagtaaaaatggtaaaacatataaatgaaaatgaatttgaaaatgaagtattaaaaggaaatggagtagtagtggttgacttttttgcaacttggtgtggaccatgtaaaatgttagctccagtattagaagaagtacaagatgaaatgaagagcgtaaaaattgttaaaattgatatagatcaaaatccagatgcagcagcagagtatggtgttaagaatataccaacaataaagatatttaaagatggaaaagaattgactacaaatgtaggatttatgccaaaagaatcattaaaagatatgataaaaaagacactttaagagaattttaaaataatatacataagataaattataaaaattagaataagatataggagaattttatatgagtagatatgatgccattataattggatttggaaaaggtggtaaaacattagcaggttttttaggaaagagcggtaaaaaagtagctttaatagaaaagtcagataaaatgtatggaggtacatgcattaacataggatgcataccaactaaatcttttgtacattcatcaaaagtttcttcgtataaggaactcaatacatttgaagaaaaagcagatgagtataaaaaggcagtagaaaagaaaacaaacttaataacaatgttaagaacaaagaattttaatatgttaaatgataatgaaaatattgatatatataatggcatggcttcatttataacaaatgaaaaagtagaaattcaaatgagagatggaaaaaaggtaatagaaggtgaaaagatatttataaatacaggagctcagtctattatacctaatattcctggaataaatgacagtaagagaatatatacaagtacatcaatgatggaacttaaagaattaccaaagcatttagttgtagttggtggaggatatataggacttgaatttgcatctatgtatgctacatttggatcaaaagtaacagttattgaaacatcaggaaagattgcaggaagagaagatgatgatatttcaacaaatgtaaaggaaatcttagaaaagaaaggtatctcatttatattaaattcaagtgtaagatcttttaaagatataaatgaagaagttgaagttagttatctagagcttaatgataattcagaaaaaactatcaaaggagatgctgtacttcttgcaacaggaagaaaacctaatatagatggattgaatcttgaaaatgcaggtgttaaagttactgaaagaggtgctgttgaggttgatagcagattaaaaacaagtgcatctaatatatgggctatgggtgatgttactgggggattacagtttacatatatatctttagatgattttagaattataaaagataacctatttggtgatggaaagagaacaattaatgatagagatattgtcccatactcagtctttattgatccaactcttgcaagggtagggctaagtgaaaaggaagcaatagaacaaggttaccatgttaaagttgctaaattacagtgtgcagcaattcctagagcaagagttattgaagaaatagatggaatgatgaaagctgtagtagatgctaaaagtggtaagatactaggatgcacactactatgtgcagaaggtagcgaaataattaatattgtggcaactgcaatgaaggcaggagaagactatacatttttaagagataatattttcacacatccaacaatgagcgaagcattaaatgatttgttttcattaatataataggataaataaagtttgaataaaaaaatagtaatattttatactttactaacattagtaattggaggcgttataggctttttaattacatcaaaaactcagaatacagtaagctctacagacacagtacaagaaaatttaaatgataaaaaaatagtatcaggctattcttttgaaaagacaaataagaatattatcaataaagaacttagtggagaatatttagatagctttgtaacaatagctgaagttcagaatgaatttactataaatttaaaaggaataaatactgacaatgtatttataattaatccaattaatggagaagtgacaaatatgaataaggataatgatgtttattctgtaaatatccaacttgataaggatataaattatggtataatagttgactataagcttttaggatctgtaagagtggtagataatttaaatgatataaaggaagatgaactttttagagatatattgataagtttaggatgtggtttgtaaagtttaatatatattggaggtagagtatgtataatgtagatgaaattatatatggttgtcctgtagaagccttatctagtatattgggcaagaaatgggttgccgaaataatctggcagataaaagagcagaaaataagatttggagaattacagagacgtgttgaagggtgtagcaagaaggttctaacacaacaattagaattgttaattgataataatataataattaatgataaaaaaactgttaacaatatagttgaatctacatattacctaagtaattcaggattagcattacttcctataatggaaaagatgataaaatggagtaataacaatcttttgtgtggaaaaaaacaataaattaaaagaatggctgctcttatttaagtagtcatttttttaataaaaatatagttaataaatactaattaaaattataatttaggaggatttatacatggaaaatgtaaatttctttattgtttttatagaaggaatattatcgattttttcaccttgtatattaccaatattaccaatatacctgagtatgctgtctaatagcagtgttcaggatatgagagaatcaaattttagaaacagtgttcttttgaaaaataccatattctttacgttggggatttcttcaacattctttatattgggctcatcaataaaagccttaagtacatttttaaatgctaatagaaatataataatgataattggtggactattgataataataatgggattattttatattggaatcatcaaatcacagttattaagtagagaaaagagattcaatgtaaaatctaagaatatgtcaccagtatcagcatttgttttagggtttacatttagttttggttggactccttgtataggaccaatacttgcatctgtccttgttatggcttcaagttcagacagtgttttaggtgcaaatttattaattttagtatatacaataggttttatacttccatttataatagcagcattattctatagtaaactttataagaaatttgataagttaaaaaattatatggaagtgataaagaaaatcagtggcattatcataattatttctggtataattatgcttgtatctggagcagttaatataaataaaatatcatcaaataagaatatggatttatctcaaaacaaaacaaatactgctaatagcaaagaaagtgctaatgaaaagcaggaagagaatatagatcaagcaaagaaagaagaatcgcaaaagaaattagaacctatagattttactttatatgatcaatatggaaataagcatacacttagtgagtataaaggtaaaactgtattcttaaacttctgggcaacatggtgtcctccatgtagagcagaaatgcctcatattgaagaattgtataatgagtataataaaaattcagatgatgtagttatacttggaatagcaacacctaatcttggaagagagggttctgtagatgatattaaagactttttaaataaagaaggattcacattcccagtagtctttgatgaaaatgcagcacaggcttttggatatggaataagttctttaccatcaacatttattataaacaaagaaggatacattactaagtatgttccaggtggaatgtcaaaagaaacgatgaaaaatttaattgaaaatccttaaaattttaagtgaaataaaatgaaaaagaggtagttaatattatgaatccagttgcatttaatattggaaacttcgaaataagatggtatggaatattaatagttttaggtatttttgttggtatgttcatagcatattataattctaaaaagttaaatttagattttgaaaagataatagatggttttttagtagcttttccatgtgcaatagtaggggcacgtgcatattatgtattttttgagtttgataattttaaaaataacatatggtccatatttaatttaagaacaggtggattagctatacatggagggttaataggagctcttataggaacaataatctactgtaagttaaaaaagattgaaatgatgaaataccttgatgtagtggctccatcacttatacttgcacaggcaattgggagatggggaaatttcatgaatggtgaggcgcatggtgatgtagtgtcatatgaatttataagtaagtttcctgaattcatacaaaaaggaatgtatttagatggacattattacaacccaacatttttatatgaatcaatgtggaatttacttattttcttaatattaatgattattttacataagaaaaaatcaaatgaaaatggagttgtcatagccagctatgcagttttatattcaataggaagattatttatagagagtcttagaactgatagcttaatgataggaaatataagaatagctcaatttatgagcattttaggagttgttattggaattacatatattatatatgtaaaaagtaagaaacatttaaattaataaaatggaaaattaaattttaaaatcgttaataaaaaataaaacagaaacatatggattaaactgttctcataaatatgtaagctagatatttatgagtggaattttctattagtttctgttttttataatatgtctacctatattgagtttaagagttgtgttttgctgaatcatcataattttttagtagttcatttgctttctcgatgtttgacattaatgtagtaaattctttgcttcctaattctttacgaagaatatagataggagctaaataatatttgtatattttatttaacttatctcgcccaagctcagtgagatttattttataacttcttttatcattttcatctttagttttatttacataaccgtcctctattaatttatctaaaattctgcttattatcgttttacttacgcccatcattttactaatatttagtggagtcatgttttcatcatgcaatgcaagacatgatagtaactctaaatgctgtgctggaatttcatattctttagaaccacgtacaatcatattcctactgaataatttaatattctgcattttttccatcatataaatccaatcaaaatcatccatactttaaattttcctccagataatatattaattctaattatttttgaatttcttgtcaacttattatgtttaaatacattatgtagtatttttaggtagttgtcagtaagaaataattttttatagtatataaattataatttattaattgtaagagcaaattttaatgctaaaatatgtattttgtagtgtgatggctttcctgttgcatcagtataaaatactgccttggaatggtccgcataatgtccacctaatccagctttttctatttcttctatacttgcattttctataagttggtggaacatagtagcaatcatttcgacatgagctaattcctcggttccaatatctgtaagcaatccttttgttttgcctgtaggcattgtatatctttgatcaaggtaccttaaagcagcaccaagttcaccatcaggtcctccatattgtgtaataagatatttagccattttaagatctttgctttttaagttaatttcatgttgtaaagttttcatataaacccacatatattaatcctccttgcgttcattttcccatggccagctttgttctacccatgcttttggattttcaaaaaaagaatgaccaaagtttgttaaagggccataacttttttcatagtcagcaattaagctttgtaatttagcagatactttacaataatcttctgttgcatttttatcctcaggaaaattatcaaggtaaagatttaggtctatagcacaaaagtggtatattcgtatgctatttaatatatcttttttagtcatctcatatcactcctttaacatttacttttctgtttatcatcataaggaatagctaaatctttaaagattgttcctttgctaaagccttccttacaagaaaaaagattttcatatttttgaagtaatatatatgatcttgcatactgtgtcattttacatccactatcttcgtgtctgtacataaaattttcatcccttcaataagttgttcacttagtaaatatactatgagaaaataaatgaaatgtgagtaaaaatatattataaagaggaaatatatacatatttagaatctatatgagtaacattgttattatttagtcttaaatttatagatataaaaaagtatatatttaaagattgatggagctaagaaatatatttacaaaacttagactgagatgtagtatgattataattaaaatttttaaatgatataaagcgaaagggaaaatggagcatgaataaattattagttgtcgtagattatcaaaaggattttgttgatggagcgttaggatttaaaaaagccgaaacacttgaagagggtatttataaaaagattaaggaatatttagagaatggagataaagtagtatttacttatgatactcattatgaaaattaccttgaaacaagggaaggaaaaaatttaccagttccacattgttacataggaactgagggacatgaactttatggacgacttaaagaatttaagcaagtaaaaaatgcatttcattataacaaagaatcatttggtatgtcaccaaagaatatgattaagatcagtgaagatataggaaataatattgatcaaatagaatttgtaggcgtggtgagtgatatttgtgtcataagtaatataattacatttcaatctcaatacattaatgcacagattattgtggattctaatctttgtgcaagttttgatgagaatttacatgagaaagctatggatgtagcagaatctttacaggctaaggttataagatagattaatgaattttacaatagtaagctgccagaagtttgtttggacagcttactatgtataataagaataattttatctgaaaacgaatcttttttgaacaacaaaactaaaaataaataaggtgcattcagttaaaagtttagctatgactaggcttacccctaaactacatagataatctaatattatatagttaaaaattagaactgttataactaaaaaaatatatcttggcaaagataatgttgtattaaattcttctttatttcgagagaatacgtagtttttattcataacataattaaaagatgaacttaaaaaacgagcactaacaacagaaagtaagagattagaagtaagtgctttgattattaataaaaatatgaaatctaggataccacttaaaattgaagacatactgtattttaaaatttgaaaatatattcttaaagaatcaattaaaggattaaaatgagaagatgtattattttctatataaacagtttctataggcacttcttttatgccatatccatatttttcggattccagaagcatattcatttcatattcataaccatttcctttaatactgcagagccatggaatcatgctttttgagaatccccttaatccagtctgggtatcggaaatcttttcaccatttataagttcaaatattctgcttgtgagtttattgccaagaatacttctaaagggaactttgccagtaaaatacctaactcctaaaattaatttatttttattatttttaatacattgagctatttttataatatccattggagtatgctgtccatcacaatcagcagtgataatttcttcagcatcgtcaaaattttttattattgagaaagcagtttttaaagtagccccttttcccttattttcattatggtgatatacggaagcaccgagatttgatactttatcaaatatactctcgtatttttcgccactgccatcatctataattagaagtttaaaattacattttgattttaaatctgaaactaatttaattaatttttcatcaggttcatatgcaggaataataacaatcataattcattctccttttaattaatatagataatatcacttactttacgttcagaatctttaccaccgggattattaacaactcttccattgaaatacattgttgatgaaccaccaccatcaaggttgtatgcataggtacagccaagatcttcaaaaagctgtgaaaattcattaagtgtcattcctctgctatagccattatctcttccatcaactacaacgaaaacaaaattattaggagatatcattcctattcctgttctaggattagaattatcaatatttctattgccaaaattactatcaatttttacattatcaaaattggttatagctttgccattatctaatagagatggtccaaatgaaaatgtattagtaacaccttgagctaatagatcattaccatttgttgctgtttcatcatatatgtttattgttccatcattaaagaaagcaagtccatttcttgcaggggcatctctatagagagttccatttcgtataatgattccatcttcacgaaaaccataatagtcaccattaatagcaaaaatggcattattagaagatgcaatgtttgaggtggtttcagtaatatttctaccaaatctattttgagcaaaagcagattttatacttgaaatatctttaacatttaagtgagcaacatagtaggttatcttattatcgccatctccagtttcttttttttcaatatttatagaaaaattattacaagaataattccaatcatcataagttacatcattttttgcagtagatgaggatgaaattgaatttgtaactgctttttcatctctttcaattaaatagcgatatgcaagtgagtagagcaaggaagagattaaaattactattagagccgtaaaaattattatcttatttcttctttttatcatgatctcacaaccttttataattattaattgattagattataagaagctaaccttaacattaacttaataaattgtataaaaatcacaataaaattacttaaagatgtggacttagcgtagaatcttactaatttctttagaatttctttagaatttaccaaagtttatttttaaaaaataaagttaaactgtgtttatagtcagtgaatagggaggatttaagatgtgaatatatgatgagcaaatactttatggggaaagagaagtgattaattgtagaaattttgtaaaaaattttttagtactatataattagtgtgaaaatataaaaatcaaagaattaatttagttggatttataaagcaaatatatatttaataatttattagtattttaatttgttaaatactaatactgtagagtattgagataataaaatttatgaattcgattaaagtttaggagtggaatatgaacttatatagtattttaatagttgaagatgaaaaagaaatatgtgacggaatagaaatatacttaaaaaatcaaggatatacagtttttaaggcttacaatggtattgaaggattagagattatagaaaaggaaaaaatacatcttgcaatagtagacattatgatgcctaaaatggatggaattacaatggttatgaagcttagggaacaacatgattttccagttataatgctttctgcaaagtcagaagaaatggataaaattatgggacttaatataggtgcagatgattatgttacgaaaccttttaatcctatggaacttattgctagagttaattcacagcttagaagatatgcaaagtatttaaaagtacttaagaataatgaaaagaaaacaaatctatttgtagttggaggtattgaactaaatacagatacaaaggaagtaactgtagatggtgatatagtaaaaatgacccctaaggaatttaacatacttcatttgctcatgaaaaatccaggaagagttttttcagcagaagaaatatatgagagagtatggaaagaggatgctataagtactgaaactataatggttcatgtaagaaatataagagaaaaaatagaaattgatagtaagaatcctaaatatttaaaagtagtgtggggagttggatataaaattgaaaagatttaataaattaaataaagataataatgaattaactgaagagataactgaaaatatagaaagagataatgagaacttagcaaataataataaaagaataaaaaaagataacaaatttatcattaatgtgattgcatttatttcaatattaataatgtcttttggaataatatttttctatcctaaaataaagataatttcaaataatgaaaagagaacaccatatgaagactataatttattatcggatatagatagctgtagttttcttctttataaagacatagttgaaaagcaaagtggatcagaaaagagtttagaagaaatatatattaaatcatatagtgacaattatgctacacatgaaaactatgaagttgactcaaattctggttatgataaaagaacaatttatgaggaagcagtattaaatcctcttcaatctcagctatataatttacaaacaaagttagactatgatttgaaaaatttagagtatgcagctatggataaagatggaaatgtaataataaataagggattagaaaacattggagaagttttatctcagaattcaggaagttatgaaagcttaaaagatttatatggattttatgtggtaataaactatgacagtaatggatatgctcaaattaaagattactatggaacagatttcagctatattagaaatatatttagtaataatataaactctcaatattcacattcttatgatggagttaaagtaacctataatactatgaaagatactacaatagtttatggtatacctaaagaattgaaatatgatgataaaatatcagatatagtagaaaatatgaatgatagatatataagccataatgctattatgatttttggtcttattgttggatgtataactttatttttaggtcttataataccttataaatttgaaagaaaaattgtaggttttaagagtatgttaaaaatgccttttgaagtagcgtgcatattttatggaatattctcaagtattttaattatgtctgccattggaatgataacagttactttaactggtgaaagtaacgaaatacttagattcttaggtattaatggtgaatttaacgatatattaatatatctatctaatgtggtgttatggtctgttataatatactttatcataagtggagtaacatatcttaaaaacatattccaatatggatttaaaaagtatttcaaggaaaaagtaatagtaataagaggaattagatatattataagaaaagctgaagatggattagattatcttaatcatatagatttaagtgacaaatctaataaagtaataattaaagttcttctaattaattttgctatactttcagctataagtataatatggttctttggaatattcgctgcaattgtttataacataatactatttgtattaataagaaaatattatgataaaataagaaatgattacagtaatttattaaatgctactaataaaatagcagagggtaatctagaaactgaaataagtgaagatttaggactgttcaatccttttaaagatgaacttaaaaaaattcaatttggatttaaaaaagctgtggatgaagaagttaaaagccaaaagatgaaaacagaacttatttctaatgtatcacatgatttgaaaacacccttaacatctataataacttatatagatcttttgaaaaatgataatattactgatgaggaaagaaaatcatacattgataccatagataacaagtctcaaaggttaaaatttttaattgaagatttatttgaagtaagcaaagcaacaagcggaaacattaagttgaatcctgtgaatgtagatattatagagcttataagacaaatagaaattgaactttctgataagcttgataatgcaaaagtagtggttaagaacaattttccagataataaaatatttttaaatcttgatagtcagaaaacttttagaatatttgaaaacttattaaataatgtagctaagtattcaatggaagggtctagggtttatgttgatataactgaaagtgaacaggatgtaacaataaatataaaaaatatgtctgctgtagagattgattataagtctgatgaaataatagagagatttcaaaggggagataaatcaaggaatactgaagggtctggtcttgggcttgcaatagtaaagagttttgttgaagcacagggaggaatttttaaagtagaaattgatggagatttatttaaatcagtagttatttttatcaaaaaacaataacactaaagtagattatttaacttaaattacttacttaaaaatataaaaacaaggttgtcttataaggcaatcttgttttttgttataaagattatatatctttataacatatattttaaagataagtttttattgctttaattaaaattagacttatagtatactatacaatagactataaatttaaaaagtatacgattggagaagcatatgaaaaaagtatttcaagttaaagatttaatattttatgaagaagattttttagaagatataaaggattttgaagatataattgaaataatacaggaactaagtccatcactatcatatgaaatgatagaagtagctggagataatggatgctgtgataaaacaaagaagaacttattagttgaaattataggttatattgatgaaaatgatgagtttattacaaaggaagaacgtgatgctatgggaagtttagctgatggaaagaactttgatttatttgttataacaatacacaaatgcactgcatgtggaaaatgggtaatttctttattggaagaatagattataaatatgagttttcatatttatccaaagataaggatttgatgaactttttatatggataagaattaaaataataaaaagttcattaagtagcagttaaggagatcattgtatgaaaaataattttttgaaatttggtatatgcatgttggctgcaggaacaattttctgtagtagtattggattccataagacagtatatggtactgatactaaacgtagtgaagataattctgataatggaattaaagaaagtttaaatgaaatttcagatacagaaattaaaagagatcctgatagtggaataaatttagatagtttctatatttcagaagataattataaagaaaatatgaataatattgtcatgccatatatagaaaatagaatgaaaagtggatatattgatggaattgacaatgctaaactatattacgaattatataatgcagatgatgcaaaaggaaatattgttatttctcatggatatacggaatctttagaaaaatatcatgaaatgatatattattttttgaagtctggatataatgtattcggaatagaacatagaggtcatggaagatctggaagccttggtgttgcagataaatctcagatatatgtaaattcattttcagattatatagaagattttaaaacttttatggatgaagttgttgttccaaatagcaatggaatggaattatatctttatgcacattcaatgggtggtgctattggaagcagatttttagaagtttatccacagtatttcagtaaggcagtcctgaatgctcctatgatggaagttgacactggaaatatacctgattttattgcaaaagttgtagttaaagcagctgtagcttttggacaagatggaaaatacgttatagggaaaaaacctttttcgccttgttattcctttgattcagttgggacaagttcagaaaatagatggacatatattaatgaattgataaatgaaaatgaggaaattcaaagaggtgaagcatcatataagtggactaatgaggcatttaaggttactaaggaaataacaaagaaagaaaatgcgtctaaagttacaattccaattttattatttcaagctggagatgatgcatatgtaagacctggtggtcagaataaatttgcagaatatgcacagaattgtgaacttgtaaaaatggataatgcaaagcatgaaatatatctagaaaatgatgatattcaaaagccttatattaaacagcttattgaattttataataattaagaaaaaatagtagtataattgttgacagatataaaaaaataagataagcttttattcagggaatgaagtctcccatgatataatctaaagtgctattaacgctgatgacttctgtggtttattttccgcagaatttatcagctttttttgtgtgcatttgtaaatactaaataataatgactcaaaatatataaaataactttagaaatacaaatagagaagagggataatacgtatgtttaaaaaaatttataatcagtataaggatatcatctttatgggaataatatcagttttcataggaataattgtaggtataatagatacgtgttttggtaaagtattgatttttataacagattttagaaatgaaaatccattaaaattaattccatttttatcaatagcaggagtagcaattgtttatatttataataaaatcggaaagaatagtataaaaggcatgactcttgtattcgaaagtgctgataaagaagatgcggtgataccaaagagacttattccattgacaatattaagtacatggataacacatttatttggtggtagtgcaggaagagaaggtgtggcagttcaaattggtgcaacagtagcacataatattggaagaaagatagatattgaaaatagtggaaggatatttttaataacaggaatggcggcaggttttgctggattatttcaaacacctattgcagctgtattttttgcattagaagttttggtggcaggaacacttgaatatagtgcattatttacagcactaatcggtgcattctcagcaagtacaacatctcatttactaggattagaaaaatttacatttgctttaaaaactaatattacaatagatctaaatttcattattaaattagctttaattgggattatttttggtgtggttggaggattatttgcccatattcttggaaagatgaaaaaaattcttggagatttaataaagaatccaatcttgaagatatttgttataggtataattttaagtattctattgatagtaatgcatacaggaagatattcagggcttggaactaatcttatctcaagtagctttaatggaagttttatatataattatgattggatattaaaatttatattcacaatagtaactcttgctgcaggatttcaaggtggtgaagttactccgttattttcaataggagcaagtcttggagtatttttaggtaatcttatgggactaccaatagaacttgtagctgctttaggatatgcatgtgtgtttggaggtgcaacaaatacttttattgcaccaatatttataggtgcagaggtctttggttttgaatatgtaccgttattttttgtagcatgttctcttgcatatattttcaatgggaataaatctatttattcagcacaaaaaatttcatatatagtagaagaattataaaaaaacaactgcttaagaacttatgtgagatatcacaattcttaagcagttttttaaaaatatttataaaataaattcacagggagaattgtttaattagttaaacgttaaaagttaagcaactgtcagtataattattgacagttgcttttatatgtgaattgtatataatttttttattttattggaataatatttttttatatgagaatcaatatgagaaactaattagaatttaatacttataaatttatgatataatatataaaaatatatgagataggtaaggtaaaaatatgcaagttaacttaagtgatttaatagaagcaatggaatttgaaaatgatatgcttagtcattattataataaagatataggtgtaatcatatataaagaagatatggagacagcttcatattttgcagaggatatagatagagttgattctatggaagaatgggaaaaggaactcatagagggactatatgatttaaagaagaatccagagaactatgttaaactcccagataaagaacaattaaatgaactaaaaataatgataaatttttgtagttcatttagcgatattgagttacctaaattagaagaatttaatgatgaaggaaagatgttgcatgaagtgaaaaatattattagaaataaaggattaattaatgagtggtatgattatagagaatattcagaaagagaaattgctattgaatggtgtaaaaaaaacaatatacaatatatagaataaatttaatgctcttattaaaaaatagttttaataagagcatgtttctttgttactataaaattacccttttggttaatataaaaattttgatgtttggataaattttatatagtatagaagtattaattatgcacacgtgaacaattaacggtaaaaattattttatattgtctatatcccctaaatactcaattggatcaatgtgtactttaactttaactacagttttgtgtccatcaacacttaattttttctttgctttttttacatcatattcactttcataaattccaagcaattgagattcgatttcttttccgttaataacacttgcttttaatacagcatacatttctttttcttcatgaactttgctaaaattaatttccatagttcatccccctttttataaaatattgataattatattctgaaactttttacctttattgtcaatatattttaagttaaaaaatgttagatcttaatatgtataatataaaaacaggagtaaatagaagaaaaacagagaaaaagcttgtaactttaaggcaagtttcaatatttaataaattatacagttaaaatgatatagtaaatagtattttaactttgactttctttgacctttaaaatataatatagttgtacaaaagaaaagagtagattttaaattgaatagcactatagtgtgtaattagaatatacgctatatgataacttgaaatttagaatcagtatgctaatttaaattaattcaaattataataaaaaataataattaaaggaggtcgtttatatgtttggattaataccaattagaacaaataatgcaactgataaaggaggagctttaagtgatttctttaacgatttctttaatgatgactttttatcaccaatgggaataggcattgatatgagcaaattcaatgcagatgttagagaaactgaaaatgaatatcttgtgtgtgcagagcttccaggagttaataaaaatgacataaatcttgattttaagaacaataacttaataataactgctaagagagaagaggtacatgatgatagtaaagatagttatataagaaaagaaagaagttatgggcagttttcaagatcattttattttgataatgtaaagcaagataagattcgagcaaaatttgaaaatggggaacttaaagtgattttacctaaggaattaaaatcaaaagaaaatagttctaatatatttattgagtgatttagatataactttatataaaagtctatgaaatttattgaaaatttaattttgactatttgactttattaataaccattgcatttctatgtgatggttgttttttatattaaggaaatatcatagaaatatattttatatgatcatgttaaaataatagtggtttaaatagtacataataatttaatatggtataattaagtaatttaaactataaagaagtaggtgtgattaatggaaaataatgaaattcaaaagaagattgatttatttttaaatgagcataagataaaaattcaaggtggacagataaatacagaaaaagatatgtcattactattgagtagaattgctaaaagtgaaatagataaaggaaattatgaaaaaggactatattttgcagttaattcttttaaatttgacaagaaaaatttatattcagtgtttttacagggattaggctttaggtttacaggtcaatatgaagatgctataaaagcttttaaatattgcaatagtagaaaacatgacttagcaagcttagctaatattggtttttgctttgctgaacttaaagatagtgaaaaagcacttgatattttcaataagattatagaaaacataacagaagaagaggaaagtaataatgcacaattaatggctttagtttatgaatgcatgggaaatatatatttatcaagagaagatgttttagaatttgactctacagataaacttaagataaactataaactggctgttaaatattataagaattcattaagattaaatagagtgaatcatgtacttcttaataaacttgcagcatgctattatcattttgatgatgaaagaaaagctttatactgttatgaagaagcagtaaaagtagctcctgaagaaaagaattatgaagaagcagtaaaggaattaagaaatgcaggagtaattccagacgttgttgaattttaactttattgaaatataggataataaaatcaatgcccattgtcatttgtgacagtgggcatttttgtaaaataaaatttatacctagtataataagttagcagttattataaatttgtgttattgtagtctttagaaaaagtatgacaagcattctgtaattaatatatataattaaaaaaataaaaagtagatgccaattattaatatattacttgatattggatttacaactttagatatatattgaaagagtgtttttgttataaatataaggagggatagattatggaaaatcttgcacttaaaaatgtagttgttataataagttattttttaatttatatttatgtattaagatacatacaatgttattcatggggagctcttaagatgataagtaggagtgtttataagatattctcaatgattggagcaccagcacatgaagcggctcatgcagtagcagcactaatatttggttttaggattactaacattaatatttttaaacatgttaagtttatggctccatcaaatttaagaggaattattggaggttttgttgtttcaatagccccagcagtgtttaatattataatttttacagttatatgctctaaaagtgataatatatattttaattttgtaatgtttttaatattaataagctgtattgcacctagtaattcagacataaaaggtatgctgccagtaatgataataggaattataattatagtagttgttacatatgcattaggatgggctgtgccttctattaatgtttatataaaaaattcaatattacttgtaggaaaattttatgctttatatcttgcagtattgaccattatagttacgataaaaggatgctttataaacaggacaattaatccattttatattttaaaattatataaaaatcttgttgttaatggattaactattatggcaaaagctagttaaagtaatcttttttagaattgacaaatgatgatattttctcatttttcaattcttttttatttattatgaaattgtaatgcagtcaaatatgtatataactttgaaatattaaaaatgtgtattattaaatcaagagcctaaataataaaaaatatgtaatctttgattatgaggaaaaacaactgttttaaaggctaggaaaattgaagttttaagaattaatatggatgtttataattttactagagaaaattatgtgaatttgttgtataatatatggaaataaatgtatattttaaatgtagaggaagaggcagttagatgaagtatattaaaaggtttgttgcatgggcaatattatcattaattattcaagttggtgcactatttatattagatagagttatatttaaacagtcatcagcatttgaaagtaaaaaaatagagttagataaaccatatgaagataagatcaacataaaaataccaaaagatgcagatgaaataaaagtatcctataacggtaagtatatgtcttattctaagggtgataaacttaacatgatcgaaacaaaaagtggaaaggataaaagtattgagacggaaaacaaaggagaagtcatgtattatgaatggttatatgagagagatatgattgtaattttagaaaaggttaataaaaagggaaaggataaaatacagcttgtaacatataatcctaaaaattcagccacaacattagtaactgaaatatgtgattttaaaagtggaatgaagataaaaaacgttactgaatcagtatttacaagtgtgtactatgtttatgtatcaaataatgaaggatatgacagatgctatagaatagatataaataatgacaagtttgatgttccgcttaagggagctggtatggaaaacatgaaagtaatacctcataaagatagattaatttatgacgatgttgtaaatagtagtatttatgcaacaagtcctaatacaaaattaaaattcaatactaataataaattgaggcttataggaatagatagaaatgatgttatttacattggagaagttagtggagataaaatttctggtatagtgtatggaaaaattgatgagagtacatcaaagtggaattctattaaacttgattcaccagcaaattcaagtgatatattttttaattcaaagagtgaaattatggtaaataatattttggaagaaaaaataaaaaatataactacaggaaaagaatatccatatacaggtaagtttattgatgtaaaagatgactttattgcactagatgataatggaaaacttgtatttcaaaaaataaaggagaattaaaagggatattagttttaattaatataggaaaatgtaattaccatagaatgcaactgtagcattttatggtaattttattagtaagtagctttgggagatttaagtgctgttataaattctgttttaaaaatctatgtgaaagtgaaatgaattcttttaaagctggtgaaatccatttatctttgtgatatatgacctgagatattatattaagatcaggccctgcccagtttaaggggattagttttccagctttaacttcatcttttacagctatttctgggagaaaagttattccaagaccactcattgtaaattgttttattgcttgcacactacctgtttccagagtaatatttggttttataccattatctttaagtattctttcaaaagcagctctataactgcatccagtttctgttagaataagtgattcatctttaatatctattggaaatatttctcttttctttattaagtcatgaccaggatatgctaaaaggagcatcggttcttttagttcaacatcagaaataaattcatcagagtctatcttaacacctaaagaaaatgcaacatctattaagttttcagatagataatgtctgaaatctgcacaacttccaaattttaatgatacatcaacatcaggataaaggtgcttatattctttaaggatttcaggtaatctaagaacacataaagattcagcagctccaatagtaagtgttcctgtaggtttgttttcattagaaacagttgattttatatcagtagatagttttaggatttgtttagcatatggtaataattttttaccttcgtgtgtaagtgttgtagtttttcctatacgctcaaataattttacatccagttcacattcaaggagcttaatttgagttgtaattgtggactgtgcataacctaaagcatcggctgctttagtaaaactctgtagtttgcttattgttaaaaacgcattaagctgtttaaagtccaaataaatcactcctatcaataaatttgattgatttaatttaaattatcaattttactaatgtataaatttatgatatcataattttgacaggaaaacaaaaacttacttattggggttaacaattatcattataatattgcaaatttataaaaatgattatatatttgaaagaggggtttcatgtaaattatatttcattaattaaaagataatgtcaaaaatatatgctttaaatattagtttgattttatttaatatttagttagaaatattataaatatgatagtaagtatttcaatatattatatatagagttgcagtatgtaagtagtttatgttattactacaatacaaagaaaagatattagttaaaggtggttttaaaaatggaaaagaaattaagagttggtattattggggctactggaatggttggacaaagattcgcttgtcttttagaaaatcatccatggtttgatattgtagcacttgctgctagtaagagatcaagtggacttacttatgaagaagcagttggtgatagatggaaaatgcctacagcaatgccagaaaagtataagaaaatggttataatggacgctgataatgttgaagaagtgtgcagtaaagttgattttgtattctgtgcagtttcattaaataaagaagaaacaaagaaattagaagaaagatatgctaagtgtgaaacaccagtagtttcaaataactcagctaatagacacactgatgatgttcctatgattataccagaaatcaatggagaacatgcaaaagttattgaaagtcaaagaaagagacttggaactacaagaggatttatagcagttaagccaaactgttctattcaaagttatgttccagcattaaatgcattaaaagaatttggtcttgaagaagttgtagtatcaacttatcaagctatttcaggtgctgggaagacatttaatgaatggcctgaaatgttagataatgtaattccatatattggaggagaagaagagaagagtgaaatagaaccactaaaaatctggggtactgttgaaaatgatattattgttgatgcaaaaactccagttatttcagctcaatgtattagagtaccagttttagatggtcatttagcaactatttcagttaaatttaagaataagccaactgaaaagcaaataatagatgcatggaataattataaagcttcagatatggttttaaatcttccaagtgcaccaaaacaattcataagatatatggaagaagataacagaccacaaacacacttagatagggattatgcaaatggaatgggaatctctatgggtagacttagagaagataaaattttcgactataaatttgtaggtctttcacataacacattaagaggagcagcaggcggtggagttttatctgctgaatatttaacagctgctggttatatcactgctaagtaaaatttaatatagagaaaaatattaagttaaaaaaacattctaactagaatttattctagtttaggatgttttttgttattttaaagaataatagaaaatttatattataaatattactaaactgtgaactgattttataccaaatgaataatatacactatgtagagtattaacaaatgaataaaaataaatcaacgatgagcaggtaaaaatatgtttatagattttaatgatatcatgtttggactaagaaacggaagatatgtttatattggttctggatcttcaagggaagtctatgatttagaaaatggctatgttgttaaagtcgctaaaaataaagctggaatagaacaaaatcgtgctgaatattatatatcagctaatgattcttcaggaatttttgcaaaggtaatagaagcatcaagtgattatggtcttcttataatgagaaaagcaaaaaaaataaaagatataagatttgtgtggaattactttaatgcaggaaataagcatgaattttatgaatcacctcatatgcagagacttaaaaataaatataaattactattaggggatttcgaaaaagcaagtagctggggaatcataaagggacgacctgtaattatagattatggcttcacacgatatgtagaaagaaaatactatcgtagattctatgaggaagacttataaattaaataatctttttattagagaagttttttagtttaaaagttttatagatttaaagttctattatttaatgaactttaaatctatatcctttaagttttaaagatttttactaaagttgatttattgcatattaaataagaggaatatagtaccaacaagatatcatataattaaagccatagtattttaaaaatattatggctttaataaaaaaattaaaatatatggagaatattttgagattttaattacgaagtttttgaaatgattaataatattatctttaatcatatcactcttgttattgataaaataataataaaaagttataaaaataaataaaattctataaaaataagcttagatatgatatattaataataaaggggcggttaaaatgaaaaggaaaattttaatgataagcataggggtattgctgttattttctggagtatattattataattgtaaagaaatatctgaaaaatatgatgagaattcttgtgaaagtaatatcaatagaatagaaatgcatccacttgattcattaaaatataagtttttatgaggtatgaaattatattaaaattaaccttaaagtctgattacatcaaattttgagtataataaaaataatgtagtaaaaagtaattatgtagtattaaagcaattaaattgaaaataaattaaaaaagtttcaaaaaaactattgatttgtaaataaatttgaaatataatgaatacaacatcaacgaaatgatgaaagcaaaaaaatgaaataagatgcgatgatgcattgatgaagaaaagtaaattctattgacgatttttagagagcagatgatggtggaatatctgtatgagtcttgaattgaaagaacactttggagcagttaaccgaacattaattttacttgaaattaattagtagacttaaccggagtcacaccgttatatgtgaaggatatagagaaagttagaacattttattacgtaaattcaacttttaaggtattttgaatatttgcagagtttaatttataaaataaaagattgtttaataaattaagctctgtgtctgctgaggcgaactttttaaaagttaaatttgggtggtaccgcgtgttatataaatatataatctcgtccctatgcaaagtgcatagggacgagatttttttattctgttttataatctttatgcattaatagagaactttttgcaaaaacggatgtaaataaaatacaaaaattactaaaacactaaaaaatgtaaataagagagattgtattataaaaaaaggagcgataaatatggaaagaacatttattaaagatttagcaattaaaggtgaggaagaagttttattaagaggatgggttcataaaataagagacttagctcatgtatcatttataatgctaagagacaaatcaggaataattcaacttgtatgtaataaggaacaaattaaaggcttgagacttgaaaattcagtagaagttagaggaattgttagagaaaatgaaaaagctctaaaaggaattgaaatagaagtaagcagtattgatgtaactggaaaagtttattatgacaagcttccatttgaaattcaaggatataaaaacaaagtatcacttgaaactcagttagattatagaacaataagtcttagaattcctaagaaaaaggcaatttttaaaattcaaaatgaaattgaagaatcatttagaacttattttaaaagcaataattttgaagaaattcatactcctaaaataataaactcaggtactgagggtggatcagaaatgtttactgtagattattttggaagaagagcattccttgcacaaagtcctcaattctataaacaaatgatggttggagcaggattcgaaagagtttttgaagtaggttatgcatacagagcagaacttcataacacatggaggcatttaaatgagtatgtgagtcttgatgtagagatgggatttattaaagatgaaaaagatttaatgaatgttgaagaagatttcttaagatatatgttcaagcatgttaaagaaacatgtggagaagagcttaagttatttaatattgaacttccagaaaaattaaaaattccaagaattccattagcagaagcacaagatatattattaagagaattcgggaaaaaatcaccagttggtaatattgataatgaaggtgaagctttattccataagtatgtaaaagaaacttatgattgtgattttgtatttttaacagattatccaacagcaaagagaccaatgtatgctatggaatgtgaagataacaatgaaatgacaaaaagttttgacttaatttataaaggcgtagaaataacaacaggtggtcaaagaattcatgattatgaaatgttaaaggaaaaaatggaaagatggggattaaaacttgaagattttgcattctatcttgacacatttaaatatggaatgccaccacatggaggatttgcaattggacttgaaagaataacaatgcaaatgttagacctaggaaatataagagaagcatcattattcccaagagacatgaagagattaatgccctagtcgaacttacccaatgaatggatataagttaaatcaattaaaaaataatataaaaagaaaggatggttagtaatatatcagttaaagaacggtcaacagtaacaattgataaatgagctttgagtcgaaaattttaatatcaactgttaactgttaactgttaactgttaactgtcaactaactaaatggtgtatttatgaaagtaactattgatgaagtaaaatatataggaaagcttgcaaaattaaattttagtgatgaagaagcagaaaaatttgcaggtgaatttgaaggaatattagaaaattttaaatatcttaatgaacttgatttagaaataaatgaagatgaaaagaaggaattaaaaccaatcgttagaaaagatgaagtaaagaaatttgaatgtaccgatttatttaggaacgttaaagataagcaggatacttatatcagagtaccaaagattattgagtaggatggtgaaaatgtaatgaaattaacattaaaagaaatggtaagtaaaataaaaagtcgtgaattaacaagtgaagagttagtatcttattacttaaaaaatcttttagaaaaagaaccaaaagttaatggatttttaactgttatggctgatgaagctttggctaaagcaaaagaaatagataatagaatagcaaatggtgaaaaacttggagcacttgcaggtattccaattggaattaaagataatatttgtacagaaggtgtaaaaactacatgtgcttcaagaatgcttgaagattttgttccaccttataatgcaacagttgtaaagaaattacttgaagaagatgctgttataattggtaaaactaatatggatgaatttgcaatgggatcttcaacagaaaattcagcattcaagaaaacagcaaacccaagagatttaagtagagtaccaggggatcttcaggtggttcagcagcggtagttgcagctgatatgtgtccagtttctttaggatctgatacaggtggatcaataagacagccagcataattttgtggggttgtaggtcttaagccaacatatggacttgtttcaagatttggacttgtggcatttggatcatcacttgatcaaataggacctttttcacaaaatgttgaagatagtgcatatatgttaaatataattgcaggtacagatctttatgattcaacaagcataagagaacttaaacatatagactatactgaatctcttaaagatggagttaaaggaatgaaaattggtgttcctgaagaattttttggtgaaggattagatgaagaaataaaagaagctgtaaagaaatccattgaaattttaaaggaaaatggtgcagaagtagaaatgttttcacttcctataatgaaagatgggcttgcagcttattatataatgtcttcagcagaagcatcaactaatctttcaagatatgatggtgtaagatatggatatagacctgaaaaatttgatagtgttgatgaacttatggaaaagagtagaacagaaggctttggccaagaagttaagagaagaataatgataggaacttatgctttatcatcaggttactatgatgcttattataataaagctgataaatttagaacaaaactaaaacatgatttatcaaaaacatttaaaaaatatgatttaatacttggaccagtatcacctgttttaccatttaaattaggtgaaaagaattctgatccattagcaatgtacttagctgatatatatacaataaatgtgaatttagcagggataccagcaatatcaattccaggaggagtttcaaaagaaggtcttccaataggtattcaattaatgggagatatgttatgtgaagaaaaaatattcaaggcagcttacagtttagagcagtctttgaaggtagaattataggaggataaaaatatgaacttagaaacagtaataggtcttgaaatacatgccgaattaaaatctaaaacaaaaatattttgctcatgttcaacaaaatttggagcaaaacctaatgaaaatacatgtcctatatgtacaggggttcctggaacacttccagttttaaatgaagaagttgtaaatttagcaataaaagcaggaacagcacttggatgtaaaataaataagttcaataaaatggatagaaaaaactatttttatccagaccttcctaagaactaccagacttcacagtttgatattccaatatgcagtggaggaactgttgaatatgattatgaaggaaaacatgtaaaagtaagattgaatagaattcacatagaagaggatgcaggtaagttagtccatgttgaaggtgagccaatatcattaatagattataacagagttggtgtacctttagctgaaatagttactgaaccagatatgagaagtgttggagaagcagtagaatttttaagaatattaaaatcaatacttgaatattcagaagtttcagactgccgtatggaacaagggtcattaagatgtgatgctaatatttctttaagaccagtaggaagtcaagaatatggaactaaagttgaacttaaaaatattaactcttttagagaacttgaaaaagcccttaaaaaagaagaaaaaagacaaagagagttaataagctttaatgaaggacataaaattgttcaagaaacaagaagatgggatgcagcaaaaggtaaaacaatatcaatgcgttctaaagaacaagctcatgattatagatatgttgtggaaccagatttaccaccaataataatttatgataatcagattgaagagattagaaaatcccttcctgaaatgccagatgaaaagagagaaagattcttaaatgaatataaacttagtgaaaaagaagttgaaatacttatttcagatattgttctttcaaggttctttgaatctgtagtaaaagaaggtataacaccaaaaatgggagcaaactggattcttggagatattttaagaattcttaatgaaaagaaattagatacggatcaaatgcctttaaatgcagaaaattttgcaaagcttcttaaagttgttaatgaaggaaagataagtaataatataggaagagaagttcttgatgaaatatttgatgaaaataaagatcctatgaaaattatagaagaaaagggacttatgcagataagttctactgatgaacttgaaaagttaattgatgaagtaattgctgcaaatcctcagtctgttgaagactataaggctggtaagacacagtcagcaggattcttgatgggtcaggtaatgaaaaagagtcaaggaaaggcaaatccaaaagtctgtaaggaacttatagatgaaaaattaagcaaactatagtttattaataaaaaagaactatcttgaaaatttggattttcaagatagttttctatttaaataatttcttttccaaaaggcattaatgatagcttagccatttttaaagactgagctgcaaatggaattcctacaattgtaatgcataacaataatgcacttaaaagattagcaatacacaattcaaaccctccgaaaattatccatagtatattaagaacaaagcttgttaatccagaagattctgaatcaataacctcttttccaaaaggtgcaagttgaagcttgcccattttaaaacattgtatacctataggtataccaattatggtgatacaccagaaaattccacaagcaaaccatcctagagcattaaaaaaacctccaaatatgaaccatataatattacctaaacaactcatttaatttacctcacaatattgaaagaatatattagtcatattatatcatagaatatttcaataatttctaaagattattgaaataaaatcttaaaaactctagctatctctattggtaaatatttaatagctagagtttaatttagtttattttaagaactttatctaaatttttaaatacagatacatcataatcttgatgtatggcaacttcaagaacatcatataatttttcaagttgctttattatttgatcaagaacaaaatcattttttacaagaagaaacattttacttgtagttccatctccaacttgtgcacataaaattccttccagattaaatgcacgtcttgcaaataatcctgtaatgtgactcataacacctgcatgatttcttacaagaagctcaataagataaaaatttgtattaatcatttaattcaccacttcctatcatttcaagattagattttccaggtgcaaccattggaagcacgttctcacattcttctataggaatgtttataacccacggaccattttttgatagtatttcatcaagtttttttagtggatcattttcagtggcaagatcacatgaatttatgccaaagccttttgcaatagtcgcaaaatcaggattagatataaactgagaagctatatagtgttcattataaaaaagattttgctgttgacgtacaagacctaaatgatgattagtcaaaattattactttcacattaaggttaaagtcagccaatgttgcaagttcttgaatgttcattaatatagatccatcaccactaaaacaaaggatggttttatcagtatttacaagtgaagcacctattgcaacaggaagaccaaatcccattgttccaagacctccagaagtaagaagagtctttggctttttgaatggatatctttgtgctgtccacatttgatgttcaccaacatctgttgatataatagtatctgatgaaacctttgatgcaatataaggaataatatttgcaggatgtaaaggattttcataagatggaagaggatacttttccttaaaacatccaactctttttatccaagataatcttgttttactattaataagaggaatcatttcttttagaaactcttttatatcagctaccatagaaagattgctatttttaactttatttatttcagaagggtcaatatcaacatgaataatagaagcattagggcagaatttttgaatattccctgtagctctatcatcaaatcttataccaaaagcaagaattaaatcagcttcattcataagatagtttgtataaggtgcaccatgcatgcctagcatgcctagattaagaatatcatcactaggaaatgcaccaagtcccataagacttaatgttactggaatactgttctttttagcaaattcacagagttcttcagaagcattagcacgaatgactcctcctccagcatatattattggtctgtgagaattatttataagttcagccatacattcaagagttgaacgtttaaaaatttttttattacatttatttatatgatcattatttattgtatcatcatagttttcagtttcagatctattagactgagaatatgcactatgaggaaatgtctccaattctataacctgtgtttgaatatttttgggaatatctacaaggacaggaccaggtctgccctcaagtgcaattctaaaagcttctggaataatggtaaaaagatcatgtatatttcttacaagaaaattatgttttgtaataggaatagtgagtccataagcatcaacttcttggaaagcatctgtaccgattgcagaaagaggaacttgtcctgtaattgcaacaagaggtatagaatcaagttttgcatcagcaatggctgttaaaagatttgttgcaccaggccctgaggttgcaaaacatactccagctgtattagtagttcgtgaaattccttgtgctataaatccagcaccttgttcatgacgtgcaagtatatgcttaattttgctcttatataaagcatcgtaaattggaagattaaagcccccgggtattcccgatatatattcaacgccttgattttccaatagtttaataactatttcagccccattatatttcaaaaaaatcactccttgaataagtttatattgtattaattttagatattaaaaaactcttcatccaaaacaataggacgaagagggttcatcgcggtaccacctaaatttgtataataatatacacactttataatattagttcattaaggtaagtattactataaaaaattaacttgaaaaatatttttcaaaaagttcaataaagagaacttataataagtatttttctgaaaaattgtatattctgattattagaaagttaataatttatactaccaataaaatcgaactaacatatacccttataacggtgggtatccgtttaagtctactctctataaagatttcttttaaaagtcaaaggctagttccataaatatctcatgagaatttacaccatccattctctctctttgcttaaataatttatgtacttctccttatcatacttgtaaatatatagaatttatattaattatattgataaatataggtaaatgtcaataagttttaaaaaaatattataaaagataggaaaatgataataataattaagaaaacatgatattagaataaattttaaaatttgatatgtttatactaatagtattatgatgtcaaaggaatttaaaaatattgtataaggatggaggtaaatatatctgaattgattcagatatattagaggtatgaaaaaaaagattatatcaaaaacattaacatttatatgtattttgctatttattagcttatttaaacatatatttggagatgcaaattctcccgtaggaattacaacggttatagctgtattaattttaatgtctgaaaatttaacagtttcacctataaaaaactttatgaaattactattaataaatatcataataggcatgggagcatttattgcaagtcaaaatatatattggggagttattatcgatttttcagttctttggtttattggatattattttagtgtaaatttaacaaaaactataatattaccttttggtcttcaatatttatttattttatatgatccagtatatggagaaaacttaataaaacgatttggagcattagcatttgcaccatttttaattatgttaattcaatatttgatatatggaagaaataaaaaaatagaagttgaaaaaagtgatatacttgagtttagcaaaagtgatgacacttatgagaaagtaaaaattttaggaatagaatttaaggttaataaaataagagcttattatgctttaagattgagtcttcttattgcaataacagcttttataaatggaagatttttattgcctaatggaatacaagaaggtaaatggatggtgtatagtatattttcattaacagaactgtttggagagaattgcagaataaaatcaaagaagagaattcaaggaactattataggagcattaattgttttaattctttttatgtttattaaatcaacaccattaagaggattgataattcttatagcaggatatttaaactcttattttgaagattaccgtgatacaatggtatgtgtgacagtttcaactgtagcatcagttgcacttacaaatggaacattattaacagctattgaaaggattttatttgtatccataggtattttaatatcgttgattggaaataaattaatattcagcgattttaaaaaaggagaaattgaataataaataaatgttttttataaaacatgttaaaatagtagtaaaagtatttttaatgttggggagatcggtatatggaggaaatgattgatatttatgatgaaaatttcaataaaattggagttaaatcaaggtttgatgtacataaatatggatttaaacataaggtagttcaatgctatattataaataaaatagataattcaaaatggatatattttcagcaaaggtcatttgataaagataattatcctggattttatgatattgcatgtgcaggacatattgatagtggagaacaagcttcaagttcaatgattagggaacttcaagaagagattggattaagagtggagaagtctcaactaaattatgctggtacaaaactagaaaataaaaatcatggtaatattttggatgatgaaatatgcgaattatatgtattaagcattgaaaatgaaaattttgttcttggtgaagaagttgaagatatggtgaaagtattatttaatgattataaaagttggattaatgaacaatataaagttttaaaggtgttttcaataaagcataagaagtatcttgaactaaatgaaaagaacatatgtggacatataagagactacaataaagattttttgaaagtaatagaaaatatataaaattagtatcgattttttattaatataaaaacaatagctttggaaattattaaaaagtttgtatctgagctttattttaaaacatatattatcatataggttattaatgataatatatgtttttattttatgaaaatttatagaaaaatgaaaacaatgtaaaaaggaagaatgctatgagcaaagatatgacaataggaaatccgtcaaagatattattttattttgcaattccaatggtacttggaaatatacttcaacagctttataacatagttgattctatgattgtaggaaattttgtaggggcagatgcacttgctgcagttggcgcatcatatccaataacatttgtacttataacagttgcaaatggagcaggtataggatgtggagttgtaatatcacagtattttggaggaaggatgttagaaaaagttaaaacatcaatatttacttcaattatatttatatcaatatttagttgtattttaatggtgcttggaattatttttgcagactggattttatatgtaatgaatacgccagaaaatatattttatgattctagttcatatatgaagatttactttatgggagtagtatttttatttatatataacattgtaacatcttgttttaatgctcttggaaattcaaaaactccacttatgtttcttttatgttcggcaattttaaatatcttattagacttattgtttgtgattaagtttaatatgggggtaagaggtactgcttttgcaacattgatatctcaaggtatttcagctttattatctttaagttttctattaaaaaagattaagatgattaaaacagatacgactgttaaaaaatttgatataagaattttaaaaaaaatatcaaaaatagcagttccatcaatacttcaacaatcaatagtttcaataggaaatttatttgtacaagctcttgttaattcatatggtgcagttgtaattgcaggatatgcagctgcaactaaaattgattcaataaccatattaccaatgtctaatatgagtaatgctgtatcaacttttacaggacaaaatataggagctggaaagattgaaagaataaagaaaggatataaatctgctcttataatgatcggtattttttgtgtttttgcagcatcattattatttttagctggtcatcaattaataggaatgtttgtagattcagtttcaaaccagggagtaattactattggaacacaatacctaaaaattgtatcggtcttttatttctttatgggacttatggttattactaatggagtccttagaggaagtggagatatgaaaatgtttttggcaagcacattaactaatttatctacaagaattatatttgcatatggattggcatcatttattggtcaaggggctatatggtgggctgttccatttggttggatatttgcttctacagtctcagttataaggtataaaagtggaaaatggaaaaatagcactgttataagactctaattaattaaaaatttattattagataaattcaaatttttgcatttatcatataaatgttaaaaatttgaatttgtttatagttgtaagcttaatttataatttaaaatacattttataaaaaataaagaaaatatttacaaaatagaaatgtgggtgtaaaataagttatgtaaattatgcataatattatatataaaattgttaacgataacaataatgaaaagggagaggtaaattgtatgaaaaaagtgagaaatttatgtttaattgcagctttaagcttaattgcagttggaggaagtagtttttatcaaatacctgttaatgcagcaacaaccatagaagtaagtaatagtggaacatctttaaaagatgcattagcaaaagcaaagtcaggagatatagttaatataactggaactgtaaaatcaggaactgtaaatgtgccagctggagttacaataacaggggaaaaggggaagagtaaaattgatttttcttcaacttcaggaagttcaggaaaaggatttgtgataaaaagtgatggagcttcaattaaaaatttagatgtttatggtgcagctgataatggaatatatattgaaggatcaaaaaacaatattacgaatgtaaatgtatacaaaaataaagacgctggagttcaactatctaatggtgcagctaataatacattgacaaaagtttattcatatagtaatgcagatcaaactggtgaaaatgcagatgggtttgcaattaagctacattcaggagaaggaaataagttaattgaatgtactgctgaaggaaattctgatgatggatatgatttatatgcagcacatggagctgttacttttataagatgcaaggctataaataacggaaattgtgatggcattaagggtgatggcaatggttttaaattagggggagtagataataaaacttcaggagtagctgcacatcttgatccactaaatcatgaacttactgattgtattgcaataggaaatacaggaagcggatttgatagaaataatcagaatggtgtggttaaaatgacaaattgtactggtgaaaataatggagaatataattttaattttcctcttaaaggtaaaccatcagctttgggatatgaagttacttttggaaaagcaattatgaatgtatgcacatcaattaatggtggaaatgtaattactggagcatctctaactgattgtacaggattttaagaaatagataagttatacttgggaccattttctaaacttttagaaaatggtctatatagttttatgctataaagataaatgttataaacattgattaagcattaatactattttttatatttctatttattaggaataatatgtttaagcaatttatgcatataaagaacattgcttggagataatattaaataggaaaatttataaaaattaataatgaatttttacttgtaatttagaaattttggaggaatattatgggtaaattattagaaaagatatttgttattgaaggtatattatttgctgtgttaggtatactttttgttttcaatcctataaattcattggtagtattaacaaatgtaacaggattgattcttgtaagtttaggaatattatatctaataagagacagaagaaacatagtaattagtataataaatataattctaggtgcaggattaattgctatgccaaccgaaagtattaatttaataataagcttttatggtgcatggtctgttgtaagaggaatatatattgttgtagatgcattgagaaatgatatggataataataagtttagtttaatttatggaggcattattgttttacttggattgttaatactattaaaccctattataagttttatttcagttccatatataataggaagttactttataataagtggattgtgtgaattatatatagggtttagaataaaatgacaaagctctagttgatttaatattattaatcatattgggttttgagcttgtcatttataaaaaatatttgcttagttacaataacttatatattaaataggtaagttatcattagtatgcttttgtattatttgaaaagaaaatcctttctctgaaacataaactcctaataaaattaatacagcaccgataaaagaatatggagtaagtttttctccaagaacaaaataagaaagtataagggtaattacaggaaggaaataaagatagttatttgttttaattacaccaagtttatctacagtataattccaagctacataacatatgcttgaagcaactacacttaaaaataataaattaattattacatcacgttgcattaaagttgataaattaaaattaaactgtgaagtaaacaataatggaatcattgttaataaagcataaaaaagatttttcttgtaaggtatattgtattgtacttattcccaaaatattttatacatattgaatatatagcccaacatagtgaagaaccaagtgctaatatatcacctaaaggatttagctttagtataaaatttccattaaatataactaaaaatactcctgtaattgcaattataaatccaataacaagatctttagttaacttttcattttttgtaaagtagtgagctaatagggcagttagtacaggtgcagtagaaagaattaagcttacatttgaagctaaagatatttttactgcagtattttctcctaaaaaatataatgatccacctgttattccacatataagaaaaataagttcttcttttaatgaagaaattttgtgaaatttaggatatattattaaaagtataaaataggcaattaagaacctataaaacatgctttcaaatggggatagactatttaataatattttacttgaaataaatgtagtagcccatattgtaacagttataaatgcaataatattaagaaaaactatttttgtattattagctttgttcatttgtatatatctccttttaatgttattaaatccatatttaagtatataaaaaataattattaaaggcaaaggaaatatagtgatttatgccttaatgctataaatttaaattatgtgtataatataaatgaactataaaatttaaaatagagcttaaataagataagttttaagtataggaaaataaggcttatataataaaggaggacaagcaagtgaagaaaaaatttgatggctatgttatttatagtgatttagatggaactttattaaataataataaggaagtatctgatgaaaataaagaatttataaattattttattgaaaatggaggaaagttttcaatcgcaacaggaagagcttttgaggcaacagaaaaatatattaatggagtaaatattgatattcctgctattgtatataatggtggggttatatatgattgtgtgaaaagaaagcctgtaaaagaaaagtgcctggaaagagagaagatgaatattgttcataaaataaatactgattacgagaatcttggtatagaaatttattgtggaacagatatatacatttttaaagacaataaaacagcagagagacctgcaactaaactattaaatattgtatatgattataaagaaaatttgtttgatttaaaatggaataaaatacttcttgtaggagaggtagaaagaatggattctattcaacatgacttaaaaactaactatggtatttacgcagtacggagtggtgatagattcttagaaatacttccagatgaaacatcaaaaggtcatgcactttcagaagtaataaatatatttggacttgataaaagtaaggtcatcgcagtgggagatgatatgaatgatgctgaaatgcttcaagaatgtggaattgctttttgtccagaaaatgcctcagacgcagtaaaaaaatatgcagatgtcatcacaaataataacgaaaatcatgttataaaaagtattgtagagtggatagagaaagataataaatttatttaaaatatataagatgattgaaggtgtgtattcatgaagttattaaaaactgaaaaagaaataaatgagataattcatactagcaatatatcagtaatttattttacaggaagagattgtggagcatgtgaagcaataaaattcaaagttgaagaaattttaaaaagctttccaagagtaaaaagtggagaaatagatggtgaaaagcatccagatatatgtgccgaatttaatgttttttcattgccactgcttattttatatgttgatgaaaaagagagtataagaattggaagaaatatagatcttttatctctagaaagaaatatagagagatattacaatatgatttatgaaaaataattatatataaaatccagaaatattcatgcagatatatttctggattttataatgaatgaaatataggatttcttctttgaaattaattaaaagaatttagattttcctaatttattgttgcgagaattacttttctttttaggagttctttcattatacgcttcactaggaatgtttttatctaatatcttgcctccaaaggcttctttttcttcaaattttatattaaattctttttcatattttttaattatgttaagttgcttaactgtggcaattgcaatagaaacaccagtattgttacctcttgcagttcttccagctctatgtaaatattcgttgacctttaaaggaagatctaagtggaatatatgtgttactccttcaacatcaagacctcttgcagttacatcagaagaaacaagaatttttatctttccatttctgaaactctctatagcaagctttctatcttctttagaaatgtgtccgttcattgcaaagcagtctttactgtggaagttaagctttgcagtagtcatttcaatatcttcattactatttacaaatatgattgccttttcaggttttgcagcgactataatttttcttaaagtttcaaatttatctcttctatcacagacaaaaagcatgtgctcaatatttggattcatttcagctttttcttcagattttattattacaggttctttcattagtctttcacatgttaatagagtttctggttttattgaagcagagaaaactagaagttgacgatctctcatagtagtttttattatatcttttgtaatttgagctcttttaggatctaataaattatcaccttcatcaataactattgttttaatagtgtgtgcagtaatttttttctttcttattaaatcaaggattcttcctgtggaacctactattatatgtggtttaatttccttaagctttttaatttgattgtttatattaacatcacctattacagaaaaagaagtaacaggaacagaagagttttctgcaagaagttttatctgtgcttcaatttgaagagcaagttcatgagtaggtgctaagacaatagcttgcatttctcgttttgatgtatcaattttatgaaatataggaagaaggtaagccaatgttttaccacttccagtaaaagcttcaccaataacatctttattttccattgcaggagtaatagcagtagcttgaattgaagtaggatcagttattccttgtttttttaatccctctattatatttgaatctaagtttaaatcattaaaagtagtcataatatctcctttgtattttatattaattaacagtctataaataaaattataaaaagactggactgattgtcaattaattataactttattatgcccactttaccagttaatagtttagatcatgtatatatttaaagataaaggggtattttttgataaatagtattttgaaattaaattttattattaaaaattttatattttacacagttttgtttttaaaaataaaaaatggtaaaatatacaataggatttaatagattaaaatataaggagaacgaaatgactgatttaattaaaggtgaatttaagaaaataaacataacgaatcatataaaaaacatagtgattgctaatattataatatttggagttttgcttgtttcaacatatactacaagagcatttaaaatatggaatatcactagtattttttatgttatagactgtttagtaagagcaacatttatgattttctcaagtatgattggttgtaaaattattatcaatgaattaaaatatggttcaaatacccaaagagacaaatatgaaagaaatataaaaacaaaaattattattatatgtataattactttttttctataatattatctgatatcattctggaaagtagtttttgtgctttaaacaaaatgttcaatatactaccctatgtgttgaacttaaatattataaaaacaaatatattttccatagtaatatatggagttacatcttcattaattagtataatacctatatactttgggatattaggaaaatcaaaatttatgacaattatagtatctattattttaatgattatgttttgttcctatgataatggattttcattaaattcaataattataataccaatatcatttgcaatattaggaatatttgcagcgtatttatctataagaaaaattaagtttatggataaataagacttaatttgtagtttaataagagtgtaaatatttcttaggaataatcattaagataaaaaatcccttaaagcaaaattaactatattgctttgagggattaatagcttttagagcataaaaaattattttaaagaaaaaaatcttctggattttcaatattcataaatccagacattatgcatactccaaaagctccataatttataacataacctatattagatgatgatattcctccaattgcaaatacaggaatatctactgaatttactatattctttaaaaaagcaagtccacgagcaggaatatcttttttgcaatctgtattaaatatatggcctgctgttacatatgtaacgttcatctttttagcatccagtgcatcacctacagaatgtattgaaactccaactacatcaaatatttcagcaatatatggtttgctttttaatatatgaagtggaagatgaatttttgaacatccaagctttcttgcaacattataataagtatgaagaatacactcagtattgtattcttcacaaattctaataacttttgaagcaagaagttcatagtctctttcatttaaatctttttctctaagaactattgatattgaccttatattattgactgattttttattataattttttgaagagttcatatgttggattttattattataaagacagattttttttatctgttctaaaaaatcacctttacacaaatgacgatttgtgattgcaagtatattatacataaacataatcactcattacaggttgaagatcatgatttattatagcattatatacttcatcaacatttctaggatctgaaatttcaaattgttcatcacctttttcttcttcagaagcatgtccaccgattccaacagacactcctgcagaaatttttgtggcagcaagtcctataacattatctcgaaagtgagcctgttcacgagtagaaattgtcatagttgcatatggcataaatattctgtatgcacacatgacttgaagtagttgaggttcatgtacatccttaggattaatcttatcattattgattatgggacgtagacgaggacaagaaaaagcaatttctgcatgtggatattttttttgaagaagataagcatgcataccagttgcaaatgcgtctttacggaaatcatcaagacctagtagtgcggcaaaaccaacacctctcataccacctttaagagcacgttcttgtgcattaagtctataagggaaaatacgcttgtgacctgcaaggtgaagtgtttcatatttatcactattatatgtttcctggaatacagtaacataatcaacgccgcattcgtgtaaatatgcatattcatcgctattcataggataaacttcgactccaattaccttgaagtattttctagcaattttacatgcttcaccaatgtattttacatcagacatggaacggctttcaccagttagaagcaatatttcttgaagtcctgtttctgcaattacctgcatttctttctctatttcttctgcatttaatctagcacgtttaattttattgtggcagttaaatccacagtaaatacaatagttttcacaataatttgcgatataaagaggagtgaacatattaatagaatttccaaaatgcttacgtgtttctatttttgctctttgtgccatctgttctagaaatggaaatgcagcaggagatagtaatgcggcaaagtcttcgggattaagaacatccttatttaatgcagtcataacatcttctgaagtatagttttcataatcataagaattcattcttgtgattacttcattcatgatattagattcttctaaaacctccatattaggaaggtatttcatatgatcaatacgttgttccattttataatccctcctaaattaatcctgtaaaaatccagttaatggtgatgatgcagaagcttttccttcaagaactcttccaaggcctgcaagataagcacatcttccagcttctatagcattcttaaaagcacctgccattgctgcaacatctctactagttgcaattgcagtatttgccataatagcggcagcacccatttccattgcctcacacgcttgtgatggttttccaatacctgcatctacaattataggaagttcaatttcatcaatgagtattttaataaaatctttagtagataatcctttatttgtaccgattggtgaagcaagaggcataacagcagcagcaccagcattaacaagatctcttgcaacattaagatcaggatacatataaggcattactacaaatccttcatttgcaagaatttcagtagcttttattgtttcaaagttatctggtagaaggtattttgaatctcgcattatttcaatttttacaaagttcccacaacctatttcacgagcaagacgggcaattctaacggcttcttccgcattacgtgctcctgatgtattaggaagcaaagttacattttcaggtatataatctaaaatgttagctgtaccgttggtatttgcacgtctgacagccaaagttattatttctgcaccagcattttcaacagctgcatttattaaatctagagagtatttgccacttcctaatatgaagcgagaattaaattcatgtccaccaattattaatttgtcattattatttatcatttttatatctccctttttattgcattatacttattgttatttaattatttaaaaatttacacttcttcaattccaagaataagtcttagtattgtattagcctcatgtccagcacatatgctaacacgtggggacataagacctcttcctatttttgcactagttgtcccatctccgcataaataaaaattatctgtgattttttttgttaaaatagtattgttgctttcaaatccagccattccagaagctgcaacaagttttttatctggaaatttttctatgaaagtattaacaatcatagctttggcttgaggattatcaaatgcttcacagacaatatcttcatttttaaacaaagtttctatattatctgaagttatctttacagtatctactgttacttctataaaaggatttatttcactaatttcatttttaagagcttcagttttaaacatgcctaaatgtttaattttgtattgttgacgatttagattactaggttcaacaatatcaaaatcaacgagatgaagatggccaacaccagttctagcaagacttatagctacgttagatccaagacctccaagaccagcaattgctacatgggcttttttaactttttcaaatacatgaggagtatgtcttgcacacattaatgcttcaaactcatcttgactaggcatttgaccctttataataaaacttatattgtcattttccttaataataaaatcatcataagtttgaaatccgttaaaaattgttatcaaattttttgtattttcataatgcttatcacgtaattcataaagagtagaacattgtgtaaaaacaggtttaccattaacaaaaatattcaaatcagccaccccctacaaaactcacaacctctagtgaatctccatcttcaagtagtttttcttcatatgatgttttaggaactattgaaccattacattcaacagctatcatagaaaagttatatccttctctttttaagaaatcacttaatttgagattatcagcgtctacaattttattgccgtttatagttatcacatactcacctcctaaaaaatgggaaatgcaaaaaaggccacacaaagacttacacccgtggtggtgtaccccttcgtgtgaccttaatcaacactctgtagaatattatagtaattaacttaaaaaatgtcaaattaaagataagaattttttaatattaacttaattagttgttaattagttgttaattagttattaagctattatacagaattaaatcgtaaaataaacacataaacaatacagaggtaggaaaaagattaatagataatatgagaatgtaattgtaaattacactaaggatataaagttaaatattgattagaaaattaagaatgaggattataaacggataaaatggaaataatgtagaacataagtatagataagataaaaatatggaagggtgataaaaatggataagggaatagcaccattagaaataaagaatgaagtaacagattatgataaggaaatattaagtatagcactagatggaatatatgggtggaaattcaatccggtagcggttattaccaatggcatagaagattattactttatatgtaaggtaaaaacaatgattgagacaattcagatgaaaatggcgaaaatatatgttcaaatacagaaaaataaaaaaccaagacttcttgcaattgaagaaatatgttaatataagcaaagatttagacagaaattaaaactaatatttatagaagataatatatagtgtgcacctgtaaaaaataaaatatatacaggtgtttttattttgaatggaaataatatataatgtactaagcgttatatattatgcagtcacgttaggagataaaatagatatgaaaaatgaatttagtaagttcaatataagtgaagaaattttaaaagcagttgatggattgggatataaaaaaccatcagaagtacaggaaaaagttattccagaaattatattaaataaagacgttatcgtaaaatcacagacaggaagtggaaagacagcagcctttgcaattcctatatgcgaaaaagtagattggaatgaaaatgctccacaagtacttgttttaagtccaactagagagctggctgtacaggttagtgaagattttgtgaatattggaaggtttaaaaggattaaatctgttgcagtatttggaaagcagcctataagtgagcaggcaagagctttaaaacaaaagacacatgtagtatgtggtactccaggaagagtgcttgatcatattgacagaggaaatcttgatgtgaaaaagataaaatattttgtaattgatgaagctgatgaaatgttgaatatggggtttatagggcaggttgaaggtgttataagaagacttcctaaaaagaaagttacaacacttttttcagcaactatttcagatgaaataagaactttatgtgaaaaatacatggatagaccagtggacatttcaatagaaaagcagaaagtggtaaatgataatattgaacatggtttatattatgttgattacaatgaaagatttaaattattaaatgaacttcttatatgcgaaaaacctgaaacggcagtgatatttggaagaacaaaagaaaatgttgatgagatttataatttcttaaaatcaaaaggttattcatgtggaagaattcatggtggaatgcttcaaaaagagaggttatctgcaatggatagttttagaaaaggagaatttagaattctttcagctacagatgttgctgcaagaggaattgacatagaaaatataacacatgtaataaattttgagcttccagttgaaaaagaagcttatgtacatagaataggaagaagcggaagagcaggaaaatcaggaaaggccatatcaatatgttctaaacatggcgatagataccttaaaaatatagaagaatatattggatttggaatacctgtaaaagaacactttacaaaggaatttataagtgaaaatttagaatctggaatatcatatcttaagtctaagcctaagaaaaaaacagaaaaagccaaggctatcaataatgatataacaaaaatatatctaaatggaggcaagaaaaagaaaataagagcaggagatattgtaggtgctatttcgagaatagatggattaactggagatgatatcggaataatagatgttcaagataatatatcttatgttgatatattaaatggaaaaggaaaaaaagtacttgatgcattaaaaaatattactattaaaggtaaaaaactaaaatgtgatagggcgaaaaaataatgaatttctgaaaaatttgattatacattctcttttacgttataatgtataggaattagtagaaatttaaacttaaaattaaaaaaattaacaaatttttattgagaaaatattattaattatagagataatagtattttaaaaatgaaattttaaaaaatataacaaagaggtgcaaagttaatgtcatttgatagaaatgcaaaatgctggtgtggaagtggaaaaaaatataaaaaatgccacttagaattcgatgaaaaaatagagtcacacaaaataaaaggtgatttagttccagacagaagcattataaaatctgcttcagatattgaaggaataaaaaagagtgcggctgtaaataatgctgttttagaccttgttgcaagcaaaataaaagctggaatgagtactgctgaaattgataagatagtgtatgattatacagtgtcacagggagctattccagcgcctttagatttctgcggatttcctaaaagtgtatgtacatcaataaatgatgaagtatgtcatggtattcctgatgaaaatgtaatattaaaagatggagacattgttaatgttgatgtatctacaattcttgatggatattattcagatgcatctagaatgttcatgatcggtgaagttagtaaagaagcagaaaagcttgttactgttgcaagagaatgtatgattaaaggtattgaagccataaagccatggggatatttaggtgatattggtgctgcttgtggtgaccatgctcataagaatggatattcggtagtaaggctattaggtggtcatggggttggaaatgaattccacgaagaaccatttgtacctcacgtaggtaaggctggtactggaatgctccttgttccaggtatggttttaactgttgaaccaatggttaatgaaggaacttatgaagtttatgaagatgcagataatggttggactatatatactgatgatggaaaactatctgcacagtgggaacacacaatattaattacagaagacggagttgaaattttagcttactaaaaataaatttagtaagaaataaattatatattctataaaagattaaataagtacattgtgagtattttacaaaaatatataaatttgaaaaaatacttgacaaatttatgttatttaagtattatatttataaaatgagtagcaatggagctgttctttagtataactaaagaatggctttttgttttttataatcaatgatgattataagtaaaattaaaagtggttaatcatttcactgtgaaaactgtttttgataaattaattagttgcatcagcaatggagctgttttatgaatttcatgaaatggctctttttttattaaaattccaaaatagaggagggaagatactaatgatattaatgaataaaataaacaaaaattttggaaatcttcatgttttaaaagatattaatcttgaagtaaaagaaggtgaaaaagttgttgttataggtccaagtggttcaggtaaatcaacgttaataagatgtataaactatcttgaagaaccaacatcaggaagtgtagttattgatggatacaatcttagagataaaagaactcttaataaggtaagacaatccacagcaatggtttttcaacagtttaatttatatcctcacatgactgttttggacaacctaactcttgcaccaataaagcttcagaatgtgagtaaaaaggaagcagaggaaagtgggcttaagtatcttgaaaaggtaggccttaaagaaaaagcagatgcttatcctactcaactttctggtggtcagcaacagagggtggcaatagcaagagcacttaatatgcatccaaaaataatgctttttgatgaaccaacatcggctcttgatcctgaaatgattcaagaagtacttgatgtacttgtaggattatcaaaagagaatattacaatggtagttgtaactcatgaaatgggctttgcaaaacaggttgctgacaggattatatttatggaaaacggaaatataattgaagaaggaaatccaaaggaattttttgaagcgcctaaaacagaaagagcacgaagctttttaaacaaaataataagataataaaattatataaaggcattttaaagggggaatatattatgaaattaaagaaattaataataacattaggacttggggcatgtatacttatgacgggatgtggtagttcttcatctacagcacaatcgggaggtgcagatacatcatcaaaggcatcagcaagtgctgaaggggcagatattcagaaaatcaaggataagggtgttttaaaagttggtgtaaaagttgatgttccaaagtttggatataaaaatcctgatacaggagagatagagggatttgaagtagatctttcaaagcagattgcaaagaaaatattaggggatgaaaataaaatcgagcttcaaggtgttactgctaaaacaagaggccctcttcttgataatggagaagtagatatggtagcagctacttttacaattacagatgaaagaaagaagagttataatttttcagatccatatttaactgatggtgtaggtttattagttaaaaaagatgccggttacacaagccttaaagacttaaatggaaagacaattggtgtagctcaaagttcaactactaaaaaggctcttgaagaagaagcagcaaatcaaggaatatctctaaaattttcagaatttggaagctaccctgaaataaaagcagcacttgattctaagagagttgactgttttgcagttgatgcatctattttaaatggttatgttgatgataattcagtaatcttagatgatagatataatccacaagaatatggtatagcaagtaaattagacaataaagaattggcaaaagttattaatgaaatagtaaatgatatgaaaacttcaggcgaaatggataagttaattgaaaaatggggaattaaataatgaatggaccttttgcatggttcaaatgggaagctttatttactgattaccatatattcttggaaggattaattgttacaatagaagttggacttttaggactggctttagctatagttcttgggacaatttcaggtgtaatgtctactagtaaaattaaattattaagaataataagcagagtatatgttgaaataattcaaaatacaccgttagtaattcaggtatttttcttatttaatggtcttccatatataaatatagtacttccagtattcttaataggtattcttggagttggtatttatcatggagcatatatatctgaagttgtaagaactggaattacttcaatatcaaagggacagtttgaagcatcatattctcaaggtttctcacacattgaaacaatgaggtatataattcttcctcaaactataaagattataataccacctcttacaaatcagcttgtaaatttaataaaaaatacatctgttttagctatgattgcaggtgcagatcttatgcataatgcagactcgtggtcaagtcagaatatgttttacggtccagcatatgttgtcacaggaatattatattttgtattatgttatcctctttctgtcgttgcaagaaagatggaacttaggaaaaagaagttaccaaagcttgaattagaagcaaatcaaaaagctaatttagcaggtcttgaagggggggtgtaatatggatatgatttttacaaaaacaaatatattatttcttcttcaaggtcttaagcttacccttattatagctgttatttctatttttttgagtatgatttttggtacaattttagctgttttaagaaactattctaaaggtatattcggaaaattagctgcaatttatatagaaatatttagaaatactccatcattattatggatactttctataaggtttcttatacctataaaaccaatgtattcaggaattttatcctttactcttttcacaacagcagcaatagcagaaatagttagaggcggaatgaattctgtgaatgctggacagtatgaagcatcatattcacaagggttttcaaagatccagacactgagatatattatacttcctcaaagttttaaaaactgcatacctacaattttatctcaaagttctactgtaataaaggatacatcatatttatgggcagttggaatagaggagtttacaggaaaaggtatgattttgatgggaagttttgctacttcaactcaggtattcttgttatttggaacaattgcagcaagttattttataattaattttatattgtcatgtactatgagaagcataaaaactgtatattaaataaaaaagctatcttaaatctaaaatgtaccctttgtcaaggacagtttaaaaaaagtctaagcaacattaagaagatgatttctgtaatcaacaggagtcatcttttttaaattccattgagccctataattattatgataggcaatataatcatctatttctttaattaaatcttcaaaagtttcacattctttaatggttgtttcatcctttaagtgtccaaaaaacgattcctgcggggcgttgtcccaacagttgccacgtctagacatagattgtccaattcctttctctttaagtttcttttgaaaaattggacttgtatagtgagccccttgatctgaatgaataaatgcatctttatgtagagttaaaggggtattaaacaagttatcaattgtttgtgtaactatatttatttttaagcttttagataagttgtgagataatatttcattagtagatgcatctagaatagtcgacaaataagccttttgaccatctttataaaatagatatgttatatctgttaataacacttttgcaggtataccttgcttaaagtctctatttaataggtttggtaagactgtatgctctttagtagctttcatcattcttctatatggatttgcttttctgtgcggacaaataatgttatattttttcattatccttctaatgcgttttaaattatagttgataccaaagaatttttgcaaagtcatttttatttgtctagcacctttttttcggtttttaaactcgaaagcagcaactacatttttataactttcttggtccttagattcttgagcatttcgtttactcattgatttaagcgaaaaataattataatatccggagcgtgaaacgccagacaatccacatagataactaattttattttttattttatatttttcaacaattgattttattacgataaatttttcagaaactaataagtttacttctttattttcacgcccctttccatcatttctaacttttttaacaattcattctcagcttgtaagagttttatctttgcttgaagtttttcatatttttcttcaatagataattccttctcactaggccttccagtattaaattttctagtatcttgtaattgtgatactccatttctacgaaatgcggagcgccatctcttaccagatgattcaacacgtttcatacctaaaatttctatattaaaatcatgttcttcaaatatttgccttggaaatttaccattattattttcaactataaatattcttttaaattcatcagtatatgtaattcctttattactaactttttttacatacttatttttagatagtattgctatttcttcttctgtaaatatcttattgctcattttatcttctcctagttctatttatttaattatacataaaagtaccctacagaatagactttttttatattgtctatcctatagggtacattttaatcaattttgatttaagatagctttttccaatttatttaaaatttaatcttttactgtttttaatttgatgacatgagtaaaataacatataattaagtgttatacttgttatatgaatataaaagtagatattagtcaataattcaattaaacatgcaaacatatgtttgtgaaattgtgactatatttttgatacgagatacgtaaaggagagtttttgttaatgataaataaatcacctcaaagtgtattggaaaaatattatggatataaatcatttagagaaggtcaggaaaatataataaattcaatagtacagggtaaagatgttctggctattatgcctacaggtggtggaaagtccatatgttatcaagtgcctgcacttatgcttgaaggtcttacaattgttatttcacctcttatatctttgatgaaagatcaagttgacacattgaaagacatgggagttgaagcggaatatattaatagtacattaagttcagcagaagagaatgacataataaataaaattgaaagaaatgaagtgaaaatactttatatagctcctgaaagacttggctcatcaggatttttgaatattataggaagatgcagcatatcacaaattgcagttgatgaagcccactgtatttcacaatggggccatgattttagatcaagttataaaaaaatatcacactttataggtattcttaataaaagacctacagttactgcttttacagcaacagcatcagaagaagtacgagatgatattataaggttattaaaacttgagaatcctaagatatttataactggatttaatagagaaaatctttttataaatataataaaaggtggagataaaaagaattatcttttagattatattaataataacagtgatgtttcgggaataatatatgcttcaacaagaaaagaagtagataatatttatgagttactaagttctaaaggatatagtgttgtgcactatcatgcaggattaagtgaagaagctagaagagagaaccaagaaggttttatatatgatagagcaaatattatggttgcaactaatgcatttggaatggggattgataaaccagatataagatatgttgtacactataatatgcctagaaatgtggaaagttattatcaggaaataggtagagcaggtagagatggtgataaaagtgaatgtatattattattttcaccacaggatgttcagattcagaagtatttaattgaaacatcaattgaaaatcctgaaagacagaatatacaatataaaaagctccaacaaatgatagattttgtatacagtaatgaatgttataagaaatttatattagcttattttggagaagagcttaaagatgattgcaacagttgcagtaattgtatgaatgaaggtgaagttgttgataaaacagtagatgcacagaaagttttatcatgtatatatagaatgaatcagaagtttggttctgggatggtagtagatgttttaagaggatcaaaaaataaaaaagtattgcaatttaaatttaatgaactttctacctatggaataatgaaagaattttcagcagatgaactgaaaacatttataaatactcttgtatctcaaggatatataagagttgttgaaggaacgtatcctattttagccttaaattcaatgtcaagaaaaatccttgtgggtgaagaaaaagtaatgcttaaagaatttgcagcacacaaaaaagttcgtgagaataatgagttgtttgaaattcttaaagaacttagaaaagaaattgcacatgaaaacaatgttccaccatatgttatttttggagatattaccttaaaggaaatgtcagttaaatatccagtttataaggaagcaatgcttaatattactggagttggtgaacttaaatacagtaaatatggtgagctatttgaaaacacaataagaaaatattctgaagataataatataaaaatttctggcgaaggtactttggaaataataacatctaacaatgataatgatctgaagcttgaaataaaaacagatgataaattatataatttattatttgaagcaagaaaaaaatgggcggaaaaagaaaaaaatgcgtatcctcaatctataatgcacatgaatattttgaaggagataagtggaagatatcctgtgagtattgaagaattaaaagatataagtggatttggacctaaaaagatagaagcttatggtgatgaaataatagaaatagtaaataattatatattagaaaataatatagaacatgtatggatacaaaaaaataaaagaaaagtgataattgatggagaaacaagaaatagtgatcaaattgcggtagatatgcttaaagaaaatgtaaatattcatgaagtatctgaaaaacttgaactatcagtttcaactatacttgggtatgtttctgaatatattaaagaatttggagaaattaagtttaatataaattttgaagagttttataatgaagaagaagaaagtgccattttaaatgcaataaatgaagttggttttgaaaaaatatcagatttaaaaaaagctctacctaaatatacaaaatatgaaagtataagagctgttatattgaaacattgtattttagcttaaaataatttgtagatacaccctattaattggaactaatattattagaattataaactgctaatgtaataatattttatctttaaaatatatttaataataaggattagaagataatgatataaggagtgtgaatttatattgaatccttatgaaattttaggaattgaagaaaatgcttcagaagatgaaataaaagaaaagtatcaatctttagcagaagaatacactttaaatcaagatgaaacaacacaggaaaaattagaagaacttaatagagcttatgatttacttatgaattccaagaatatatatgcagaaataagaaaattaatagaaattaaaaattttccacttgcagagtctaaacttaatatgataaatgaacgagacaatgctgagtggaattatcttgaaggttttatttgtgttcaaaaaggatggtttgaaactggattaaattatataaagaaagcattagaactagatccaggcaatactgaatatataagcagtatgaacactcttcaggctagaattatagaatatgcaactaaatatgcaaatcaaggggtaagaccagctgctgcaaataatatgaatgcttgtggcggtggtggtggaaataatggcggaatgtgttaaaattttataatgcagagtaaaaagatattttaaaatgtagatattttaaaatatctttttattttgcaacaattttatgttcataattgtattatatatgcagataaataaatttgtcatattattggaaagtgatataatatttgagcatattaaaaagctgaaaatcaatttttggtggtgataaaatgaaaatatctgatttggaaaatataattatacgaaatacatctaaaataaacatgacaagagggaaaaagttattagatgataaagcattcactattgacgttcataaggtagataatttttataatatttatggtaattttaaaagtgagaataattttaaaaagtgtaatcctcacttaagaatagatatgaaaaataaaaaaatatcttttacaaaatgcaactgtaatatctttgagggtggcgagttagaaaataagatttatatgtgtgaacatctagtggcagcagcaatgaagtttgttgaaggaataaagaaaaaattagctttaaaaagaattgaagaagagagaattgacaaaaaaataataaaggaattagaaaatatatatttgattcacagtgatgagaaggaaaaggtatttgataaaaaagaaaagcttgttcttaatgtatcaataaaacaggtgaaagaagaaagtagtaatgattttgatgtgagtatatatattgggaatactcatatgtatccaattttaaatataaaaaactgtgtatgttcaattataaaagatgaagagtattgtataggaaaaggtcttgtttatgacaagaacaagtattattttagtgaaagtgatgaacaatttattaaatatatatatgaaattatattaattagtagaaataatgaaagcacaagttttataagaatatcttcagaattattgaaaaaatttcttgaaaaattaaataataagaagattaaatttaactataattatcaaagttatacaagtgtcatattaaattctgatctaccattaacatttactatgaagaaaataaatggagattatgttctaagtactaagaaaatacttccgatacctttaagtaaaactagagatatatttttatatgatagaaatatatatattccatcattaaaacaagtggatttatataggattttatacaaatatataaaagaagacaaaaaaattatttttaagagtgatataaataatagtgagtttggtgtattaaataaagtattaacatctatatctcaaaatatattttatgatgaagcaataataagtaaaatgaatgaggatgttagaattaactttaatttttcaagaaaaaaaggaaaatcagtatgtgatgtaataatcaaaaataatattatagatatggactattctgaggctattaaaataaataatgataaattcaattattcaaagaaattaatgaatattgaaagtattttaaataaatatagattttattatagaaatgagaattttgaatttttaggagaagatgaagaatattatttgtttttaaagaatggaatagatgaaataaagagtataggaactatatttacagaaagatcatatatagattactttaaattaaataatggaagatttaaggatttgtcaattaaagaaaattcaaaaggaatgtatgaattttacatgcagtttgaaaatatatcaccatatgaattgaatgatgtagtaaaagcatataaagaaaagaaaaattttataaaacttgataataatatatatgttgacttaaaaagcaaagagattgaaaaaattatgaaaattatagatactttaaatctagatattatgagtggaaaggataaattttacctttcaattgataaattatattatttaaaagataaaatagaagatgatcaaatagtatttaagaatagagaaaaaatactggatttaatagatgcacttcataaaaaacaagataatgtctatgaaatacctaaaaacttgaaatgtaatttaagagatcatcagattgaaggatataattggtttaaaaatcttagtgatcttggtcttggaggaatacttggagacgaaatgggtcttggaaaaactattcaaacaatagcatttcttgcttcagagaaaaatgggacttccatggttgtagtaccaacttctcttttatataattggagcgatgaatttaaaaaatttattccaggtttgaaagtttgtattatcaatggtgagaaaaaagaaagagaaaaaaatattgaaaattattgtgattatgatgttttaattactacttatggattgattaaaaatgatattaatctttatgaaaatatagaattcaaaaatataatattagatgaagggcagaatattaaaaattataaagcacagataaccactacagtaaaaaaacttaaagctaataatcgattcattcttacaggtacaccaatagaaaataatcttaatgaattatggtcattatttgatttcattatgccaggatacttatatacatataaagtgtttaatgaaaagtttgtgaaaaatgaatccaatcttgaagaacttaaaatactaataaagccatatatactaagaagaaccaaaaaagaagtagcgggagaaatgcctgaaaaatatgagaaaaaaatattggttaatatgccaaaagaacaaaaagatgtttatgatgcttgtgttaaagaaatacaagataggattaatagcgaaaaaatgaataatataacgatcttttcattcttaacaactcttagacaattatgtcttgacccttcattagttactaatgaatacaatggagaaagtgggaaatttaatgaagtgttaaatatcataaagaaagatcaaaaagaaaataagattctgttattttctcaatttacaaaggctctcaagaaactagctttaaaactagataaagaaaaaatacagtattgctatcttgatggtagcatatcatcagcagctagaattaagcttgtagaagaatttaataatgataagaataaacgagtattcctgatttctttaaaagcaggtgggacaggattaaatcttacaagtgcaaatatggttattcactttgatccgtggtggaatccatcaatagaagatcaggcaacagatcgtgcacatagaataggtcagaaaagggatgttgaagtaattaagttaatagcaaaaggaaccatagaagaaaaaatagttcttcttcaagaagataaaagaaatctaatcaatgatgtattgacaaatgaattaaatgatagtgaagtattcaatttagtaacaaatagtgaattgattaaccttctcaaataaattaacagcataaaagtaaatgttaattaatggtaatatatctcatattataaatatatgaaatatattactattttgatggaaacatataccgtataaaatattaaaaaagatattcgattataatattataaagatgtaatttaaatattgtataactattaatagtacattattaaatgaatcataaatttacagttaaatgttaattaaatatgattaatatgttaatattaatatgtggacaagttaaaaaggaaaaaattaagttttgtagtaattttggaagattaataaaaaggtaccgaaatacataactttttttgtatataataatgaccgaggaagggagcgcaggtatgctcgaaaatgttttaatagatttaaatattgaaggacaaactacagttgacaggctgatagaaaaacatatgccattcataataaagagtatttcagatgttacagggagatatgtatcatgtgaaaatgatgaagaactaagtgttggtctacttggctttaacgaagcaattgagagatatgataatgaaaaaggacattttttatcttatgctaaacttgttatttcaagtagaataaaaaattatttgaaaggcgaaaataagcatcaacattcatctctagaagaacttacggagatggggttagaatttaaagatgaaaactttgagcaggaagaagacaatagtttgttagtagaacagattgaaatgctgaaagctgaaatcaattcctttggttttactttagaagatttaatggaagaagcaccaaaacaacaggcaacaagagaaaatgctataaatttatcgaaacagatatgtgaagaagaggaatttatatcattcatgtatttaaaaagaaggctaccaataaagaaaatagttcttagatttggagtcacggaaaaagttgttaaacgaagtaaaaaatttataatagcagttgttataattattaacaaaaatcttagcgccttgaaaaattggatcaggaagtaggtgatatttatgaaaaaaggtttaataatggaaattaaagatgaatatgccattatgttaaatgatgacggcagtatggataaaatcgtagttaagccacagatggtagttggacaaaaaatattttactttgaagaagatattgtaaaaatttcaacgacgactcaaagtaaatttaaatataatgtatttatgaaatcatttggatctattgcagcattattcttaattgcatttacgtttttttataacatacatgtaaacaaaacttatgcagttgttagtctggatattaatccaagtatacagttagaagttggaaataataaaaagataattaatgttgaaggtatgaatgatgatggaaagagtatagatttttctagtgttaaaggatgtaatataaatgatggtattaaagcagtaaaagacattcttgtagaaaaagagtatttgaaaaataataaagatgtattagttggatttgcatttgttaaaaatgaagataagactgcttatgaagataatataatagatgctgttttaacaacatttgatactgaaaatgtagcatacattaaagtagacgataagaatgatgttgaagaagctaaggaacaaggtataagcttaggtagatatgaagcgtctaaagtagttgatgaagaaacaaagaaaaaaatagtaagtgctccagttaaagatattacagagcaaattaaagataaagaaaatgtaaaatactataatgctgatgaagataaagctgaagatgtaagtgcacctaaagaagaaaaggttgaagataaaatcaatatgataccagcagacaaaccagcagacaataatagtaatacaaataatgctacaactaaggagactaaggaaaacgggaataatgcaaatcataagcctgatattgtagctccatctgatgagaaaactccagcacattctgataagagtgaagagaataatgataagtcagaaattaataatggaatattggaacttaatccagaaaagcctgctgaaggtgaaaatagtagcaataatcaggatggggataaaaacactgttatagatccagataagaatgttatagaaaataacacaacatcaggaaaattagaagaagataataaagttcaggaagttgtgccagatagtagtgttgaaaaaccaaaacaaggtaatataaattaatttatgaagatgtagatgaaaagtctacatctttttttcataaatatgaaagattaaatatagttaaattttgcgtttagatatggaagggcattttaataaatatataaaaaattaaagactaaaaaaaaaattatagtatacttacaatagaattattaagaaaaattggggagatatacatgataaaagaatttttaaacaataatatattaatatgtgatggggcaatgggaacatattattctgaaaaaacaggaaatgacatatcctactgtgaatttgggaatttaaacgataagaatacaataagaagaattcatgaagagtatatagaagctggggctaagcttataagaacaaatacttttagtgcaaattcaaaagaacttggagtttctagaaaaacacttaaggatataattgaaagtggaattgaaatagcaaaagaggctgtatataataaagaagtttttataggtgcaagtataggtcctataagagaaaatggagcagatgaaaatgttgtagaagtattagaggaatataagtttatagttgattgttttttagataataatataaatgtatttatttttgaaacattaagtaatttggattatttagaagaagtaagtacatatattaaaaataaaaaacctgaaagtttcatattgacacaatttgctgtgaagcctgatggatttacaagagatgggtatagtgtatccaaaattgttggcgaagtaaaaaaaataaatactatagatagctatggttttaactgtggttctggtcctactcatgctttagaattaataaaaaagatagacataggagatgatattgtatcatcacttcccaatgcaggctttccagagataatacatgagaggactgtttatccaaataatcctgtgtattttgcacgaaaagtaaaggaaataaaaaaattaggtgtatcaataataggaggatgctgtggaacaaatccatcttatataagtaaattaagagatacaatagataataagccagaagctggagataaaattaaaagatatgaacatgaaacatataatgaaaaaaatataataaagaatacatttaaggaaaaagtaaagaatggagattttgttattgccgttgaattaagtgcaccagtagatacagatataaataagataatgactggagctaaagtatgcaaagacaataatattgatattgtaacagttccagattctccaatgtctaaggttagagctgattcagtagtaatgtcatcaaaaataaaaagagaaattggaatcgaagcaatgcctcatatgtgttgcagagataagaatactaatgcaataagatcaagccttataggaggtcatatagaagaaataagaaatattcttgctattacaggagaccctataagtgatgcaagtagaattgagacgaaaagtgtatttaatctgaattcttttaaattaatagaacttattaatgatatgaataatgaggtattcacaagtgatgatatatttattggtggtgcgcttaatttgaatgttcttaacaaggaagttgaatatggtagaatgatgaaaaaagttgaaagaggtgcgaaattctttttaacacaaccaatttatgatgattctgcggtagaatttttaaaaagtataaaagaaagaactgatgttaagatacttggaggcatactgccagtagtaagttatagaaacgcaatgtttttaaataacgaacttccaggggtaacaataccacaagaaattttaaatagattttcagaagatatgaatagagaagaaggtcagaatattggtatagatattgcagtttcaatgggcaaaaaattaaaaggtatatgtgatggattatactttataacaccatttggaagagtgaatatgatagttgatattgtaaatagaataaaagaagtatagcaaatttacaaaagagcggcatttatagataatgccgctttttctgtatatattgtgttataaagtgtataattaagataaatagtatatgtacatatattttttagatgattattccaatataatagtatgagataaattaaaatttattaaagtaggaatatatgataaaatatacattaagaaaatgtaaggagtgttaaaaatgagtgtgacaataaaagatattgcaaaacttgctaatgtttctcatacaacagtttcaagagctcttaataatagcccatatataaatgaagaaactaaagcaaagattaaagcattggctaaggagttgaactatgttcccaattataatgctaaaagtcttgttttgcttaaatcttatgtaataggtgtattcttctcatcaataagcgaaggaacatcagatacgttcttccatgaaattgttaagggtgtaaataaagtaatggacaaggagtataatcttgtcataagagggattgataattatgaacattctcatcctattgacaataaaaattttgatggaattatagttgtaagtcaaagcaaaaatgatgatgagtttattaaaacaataatagaaaaaaatattccaatggttgttattaatagagatattagtgtagatggtgttataaacgtattatcaaatgatacaaagggttcatatgacgcagtacagtatcttataaataataatcacaaaaagataggaatgattcagggtaacttagagtttgaatcaagtacatatagaaaaaagggatatattatggctcttgaggaaaacaatattaacgttaacaatgattatattttaagtggaaagtatacacttgaaagtggatatcataacatgaaaaaacttttaaatcttgaagataaaccaacagcagttttttgtgcaaatgatgatatagctgttggagctatgaaagcaatatttgaaagtggtcttagagttcctgatgatatatcaattatcggatttgataacagtaatttctgtaattatgttacaccaacacttactagtgtaaaaaaagattctcttacgatgagtgaaatagggggtattaatcttcttgatataataaataaaaaattaataaatcaagagaaaatatttatagaatcatatctcgttgaaagaaattctgttaaaagaatttaattttgaaaaaaatcgccaaataatataaaaaaataatattatttggcgaaaaaatctgttaacgttaacaaaaaaggacttgcattatctttggaataagattataataagtttagttaatgatactaacaaattgttcacgttaactattgcttgcacactcaattgttaacgtgaacagcaaatataataataaggggacctgtaaaatgaaagaattcatggatgaaaattttttattaacaaattctatttctgaaaagttgtatcatgagcattcagaaaaaatgccgattattgattatcattgtcatataaatccaaaagagatattagaaaacaagaaatttaaaaacataacagaaatatggctttatggcgatcactataaatggagagctatgagaagttatggtatagatgaaaaatatataactggtgaagggtctgattatgagaaatttttagcttgggctgatacagtttcccatgcaattggaaatccactatttcactggacacatttagaattaaaaagatactttggaatagatgaagtattgagtaataaaacagcatcagatatatgggaaaagtgtaatgaaatgcttcaaaaagatgagttcacagtacgaggattaattaagcaatcaaatgttaaagcaatatgtactacagatgatcctgtggattcattagaatatcatttggcattaaaagaggacaagagtttccatgttaaagtattgccagcatttaggccagataaagctttaggtattaataaagatacatttaaggaatggttcacaaagttagagtcagttgtaggtagaaaaataactaattttgatgaatatttagaagctttaaagtcaagagttgaattctttcacagtgtaggatgtagggttgcagataatgcgttagattttgttccaagaggaaatgctacattagaagaactaagagagatttttgcacatgttctaaaagatggacaagtatcttttgaagatgaaaataaattaagagtttatatattaaagttctttggaaaattatactatgatttgggatgggtcaatcaattccatatgaattgtgtaagagataataatactacaatgtataataaattaggtcctgatactggatttgatgctcttaatgatacacaagtagctgttccattatctaatttattgaatgaattaaatgaagaaaaagcattatctaaaacaataatatatagcttaaatgctaatgataatgcagttataggtacattacttggctgcttccaaggcgatggaataaaagggaagattcagcatggatcagcttggtggtttaatgaccataagttgggaatggaagcacaaattaaatcattagcaaacttaggaatgttaagtacatttgttggaatgcttacggattcaagaagtttcttatcttatacaagacatgaatatttcagaagaatattatgtaatgtaattggggaatgggttgaaaatggtgaattaccaaatgatactgaattcttaggtgaaatagtaagtgatataagttataacaatgctaagaattactttaatatgtagttaataaatatttatttattaatatagcagcagttttctgttaattggaaattatcctttataccttgataacattgagtaaaccataccatattttatttacaatcattcaattaattgaaagctgcgctttttaaaataatgcgattttatatagatattaattcaattaggcatatgagagaaaataggcagatagattgaattggcattttttataatgccttaaattagagagaatagtaaaaatctttattgaggtgaagaaatgaaaagagaagaagtattaggaagagtaaaagaagctggagttgttgctgttgtaagaggaaactctaaagagcaaggtttgaagatagttgaagcagcagttaaaggtgggataaaagtaatggaacttacaatgacagttccaaatcctgttgattttttaaaagaagttgtagagcaatataaagatacagacattattgttggagcaggaacagtcttagattcagaaacagcaagagcttgtatattagcaggagcacaatttattgttagtccaagccttgacgtggatacattaaaattatgtaacagatataaagtatgtgttatgccaggtgttatgaatgttaaagatgcgattactgctatggagtatggagtagatgttgttaaaatattcccggcaaatctttatggaccatcagtaatttcatcatttaaagggcctcttccacaaggagattttatgccaacaggtggagtaactgttgaaaatttaaatgaatggtttaaagctggtgctgtagttgttggaacaggtggaagtttaactaaaggcgctgcaactggtaattatgatgcagtagaaaaagaagctagaagatttatggatgcatatagagaagcgaaggggatttaaaaatggatgtagtaacttttggagaatcgatgattgtttttagccctaaatcacatggaccattaagacatgttcatacatttgaaaaaacaataggcggagcagaatcaaatgttgcaacagctctttcaaaattaaatcatactgtgggatggttttcaaaattatcaaatgatgaatttggaagagatgttgtaagttctattagagctgaaggtgtagatacatcacgagttattttagatgagaataataatactggattaatatttaaggaatattatcaaagaagtaatcctaatgtttattattatagaaaaaactcggcagcaagtacaatttctccagatgatattgatgaagaatatattaaaagtgcaaaaatacttcatctaacaggaataacacctgctttatccaaaagtgcaagagaatcagtttataaagcgatagatatagcaaaatcaaatgggattttagtatcttttgaccctaatataagattaaagttatgggacttagaagaagcaaaagaaattttggtggatattgctaataaagctgacattgtaatgccaggtctcgatgaagcagagattcttttagggttaacggataaagatgaaatttgtgattactttttaggaaagaatgcaaaaatagttgctataaaactaggggctgaaggatgctacataaaaagtaaagaagaaagttgtatggtaccaggatacaatgtatctgatataattattgatactgttggtgcaggagatggatttgcagcagggtttctttgtggatatcttgataatttatctttagaggaaattggacaatattcaaatggaatgggagctatggcgactcttgcaagtggggacatgacaggttatccgagttttgaacaacttatggagtttattgggaaaaagcatggagtagatagataagcataaataatgggattattaaatagaaagtagagagtttgtattgaaaatattaattattatatgaactcttggctttcaaaaatgttaacgtgttcttggtataatttaaatttgacaatacaattttatatagttgtatagtattgtgaaatttaaattattatatagataagaatttggaggagtaaaaatgaaattaaatagagaatcatataaaaatcataaatcatatccagtaaaagtaatccaatttggagaaggaaatttcttaagagcttttgttgactggcaaattgataaaatgaataaagaagcggattttaatggaagtgttgcagttgttcaacctttagaaggtggattgattcatatgcttaatgaacaggattgtttatatacattatatttacaaggaattcaaaatggtaaagcaactaagacgcatacagtaattgattgtatagatagagcagttgatccgtataaagattataataaatatttagaacttgcagaaattccaagcgttagatttataatttcaaatacaacagaagctgggattgtttttgaaaatgatgataaattagaaagtggatgtcaaaagggatatccatcaaaattaacggctcttttatatcatagatttaagacatttaatggagctttagataaaggattaaatattatcccatgtgaattaattgatagaaacggagaaaaattgaaagaaattgtattgaaatatgctgaaatatggaacttaggagatgaatttattacttggatcaatattgccaatacattcttttgcagtttagtagatagaattgttccaggatatccaagagatacaattgaagaagtaagagctgaattaggctatgatgataatttagtagatgtaggagaagtattccatttatgggttatagaagggccacaatgtcttaaagaagagttaccaatagagaaggcaggtctcaatgttaaagttgttgatgatatgacaccatacagaactagaaaagttagaattttaaatggacctcatactgcaatggttccagttgcttatctttatggtttggatacagttggagaaactgtagatcatgagattatgggccaatatgtaagggaattaatatttgaggaaatagttccaacattagatttaccacatgatgaattagttcaatttggtaatgatataattgaaagatttcagaatccgtatgtaaaacattatttaatgagcattgcattaaattcaatgtctaaatataaaacaagagacttaccaagcttaactgaatacttaaagagaaaaggagaactccctagaaaattagtattctctcttgcagcattaatagaattttataagggaaagagagggaatgaagatattaagcttgctgatgatgagcatatattagaattatataaaaatttatggtcagaatgtgatggatctgaaagtggattaaagacattggttactaaagttcttgcatatgatagaaactggggtatggacttaaatgaaattgaaggcttaactcaatctgtaactgataatttaattttaattgaaaaagcaggaatgaaagaagctgttaaatcagtactttaatttatattagaagtaataacatatatattagataaaaaataacaacaacttaataacctattactcattattataaaaaataacaacttaattaattgatagataacttaaatataaaatggatatatatgttgttataaactgataaaattaaactactttaattttagctgcttattaatttgtttttagttcataagcagcataatattaagtgtaatcttaaaatatataaggttacacttaaccctaaataaattgattaaaaaatagcaattagtttaaggaaaagcaggtagaaaaaatgataaattttataaagataaataataaggataatgttgttgtagctcttaaagattttaataagggtgaaacaatcaaaactgacgaaaaagaaataactttaaaagaggatattaaaagaggtcataaaattgcaattgaagatataaaggaaaattgtgatgccataaaatatggatatcctattggatatgcaactaaagatataaatataggtcaatgggttcatacacataatataagaacaaacttaaaggggataaaagagtatgaattcaaccagtcattgaataaattggatataccagaaagaaatttgacttttgaaggatatgaaagagaaaatggatctgttggtataaggaatgagctatgggtagttccgacagttggatgtgtaaatggaattgcagatagaataattgaaaaatttaaggaagaagtgaattttgaaggaattgacggtgttgaagcttttaagcataactatggatgttctcagcttggagatgatcatgtaaatacaaaaactatgcttgggaatcttgcaaagcatccaaatgcaggtggagtattagttttaggattgggctgtgaaaacaacaccatgatagactttatacaatcattaggtgaatataatgaaaatagaattaaatttttagtatgccaagaagtttctgatgaaattgaagaaggcgttaaaatcttaaaagaactatattttcaaatgaaaagtgacaagagagttacacttcctatatcaaaattaaaaattggcttaaaatgtggtgggtctgatggtttatctggaataacagctaatcctcttgttggaagcttttcagatcttttagtatcacagggaggaactacaatactaactgaagttccagaaatgtttggtgctgaaactattcttatgaataggtctaaggatgaagaaacatttgataaggttgtacatttaataaatgactttaaacaatactttatgaaatatgatcagccaatatatgaaaatccatcaccgggaaataaagcaggaggaattactacacttgaagataaatcacttgggtgtactcagaagtcaggaaatgctactgttgtagatgttcttaaatatggtgaaactctaaagactgatggccttaatcttttaagtggtccaggaaatgatttagttgctgcatcagcattagcagcagcaggatgtcatatggttttatttacaactggaagaggcacaccttttggtacatttgtacctacaattaagatatctacaaactcaccattatataaattaaaaccacattggatggatttcaatgcaggatgtcttgtagaagataaaactttagaagaaactactgaagattttatgaaatttgtaattgaagttgctaatggtaagcatgtgaataatgaaattaataaatttaaagaaattgctatacttaagcagggcgtaacactataaaataaagcaaaaaatataaatatactataatattttattttaaaattaggagggatgtaaatgagtgaagaattaagaagtttttcaatggactttttttcgttaaaaggaaaagtggccatagtaacaggtggaaataagggtttaggacaagcatatgcaatagccttggctaaagcaggagcagatgttgtaattccaactcatggaaaggagtgggatgaaacaagaaaactcatagaagacacaggaagacaagttacatttattcaaggtgacataacaagcagagaagatagagagaatataataagaatctcaatgcaagtttatggaaaaatagatattttagttaacaatgccggcacaataaaacgagcacctcttttagaatataaagaagaggattggaatgcagtaatggatataaatttaaattctttatattttttaagtcaagatgttgcaaaaataatggcagaacaaggcagtggaaagattattaatattgcatcaatgctttcttttcaaggcggaaagtttgtacctccatatacggcaagtaaacatggtgttgcaggaattacaaaggcttttgctaatgaactagcatgcagaaacatacaagttaatgcaatagcgcctgggtacgtaaaaacagctaatacaaagcaaataagagatgacgaaaagagaaataaagaaatactagataggattccagcagaaagatgggctgagccttttgacttgatgggagccgtagtatttttagcaagtagagcatctgattatataaatggacatatacttacagttgatggcggttggcttgtaagataaggagtttaaaataagcttgtgaaaagatgaaaaacttatcacaagcttattttatagaacttatatatttattgaaaagcttttaggaaaataaaattttttatggagattctttttgagtaataaaaaagttaacaagtgcacttcctgaaattattatatatcctaaaatagataaaatatcaggaatttctttaaagagaacgagtccgtaaagagcagaaacaattaatcctacataatcatacatagcaatacttgaagcaggtgcatttttatatgctagcgtaaggctgatctgtccaaaagcaatacaaaatcctgcaaggatcatgaatacaactgattctttatttttaaaattactaatatttataaatataaaaggtaagcttgctatacaagcaaaaaatatattataaaaaataatagtaaatttattttctttgtcgcctattaatcgtatcattgtaaatgcggttccagcacaagcagcgccgcataaaccgattaatgatggaattatgctgaaagagaaacttggttttattattaaaatagaaccagccagagtcaaaatgagaaataaaacttgttttttgttaatattatcttttaaaaatatgcatccaaacaatacagcaaaagatggtccgagttttgaaagcattgtggcatctgatagaatcatatggtctagtgtataatacaaacaagctagtgataaagtaccacacaaaccccttatgttaagatgtttacggttttcttttcttccgaaaaaagatatgttgttctttagcattacaatagctattattaaaaaagctatactgttagaaataaaagctttctgataaagagagacatcagaagcaagtttgcttaaaaggttcattgtcgtaaaaaatattgatgatagtatcataaagcagattgcttttaatcttttgcttaacttcataaaaatattctccttataaaaatatatgccatattagaattaccaaaaaagttctagcttattcatatattttgttaatgcagaatgcagagtagacattatttaaggaaaagatataatacattgaatgtaaataattcaatcatatataaattaaaaaataatttggaaaacgtgttcaattttctcaaaaaaggtattgaaattgtttaaataacattatataataatattatattcttaagcacacgtgtgcaaaaacatgaaatgtgcacgtgtgcaaaagataacaacaatgttgttgataactactaaacatacgaaatttgaattatacttatttatattaggaggatggataatgaaagattatgcaaagtggatggctgattcagtcattgctagaaaaactgatttaactagttactgggcttatgaatttgggttaactttagatggtatagcagaggtttggaaacaaactaaagattccaagtattttgaatatattaaagagtgtatggatacttttgtaaatgaagatggcacaataagaggatatagtgttgatgaatataatattgatcatttaaataatggaaagatattattaacaatatatcaagaaactcatgaagaaaaatatagaaaagcattagagttattaagaactcaaatagctaaacatccaaggacaaaagaaggagtgttctggcataaagaaatttatcctgaacaaatatggctagatggtttatatatgggagcaactttctatgcgaagtatgtaaacgaattcggagatgtttcagaatttgatgatattgcaaaacaatttataattgcaagaaatcatacaatagatcctaattcaggactattatatcatgcttatgatgatgctagagaacaaccatgggctgataaagaaactggtttatcaaagcatttttggtcaagatctatgggatggtttgtaatggctcttgttgatacattagaagaattgccagaagataataaatataaaaatgaaattttacagatatttaatgatacaatgaatgcattaattaaggttgctgacaaggatgcacacgtttggtatcaagtacttgattgtggtgatagaaaaggaaattatcttgaagcatcaggttcttcaatgattgcatatgcactatttaagggagtaagacttggatatttaccagaagaattgagagagtttgctaaggaatcatatagagggttaattgatgaatttatattagaaactcctcttggattaattaatcttaataaaatatgctttgtagctggtcttggaggaaaggataactgccatggtaagagagatggatctttttcatactatatcagtgaacctatagtttgtaatgaaccaaaggggcttggaccatttatcttagctgcatctgaagctaatttactgtaacagtgttgtattatcagtttcataatacatatcttgtgaaactgataataactataatattctatgtaaataattacaaggatttaaaagtgcagtatttaagaagggagaataacagtgggaaaattagcatctatggatgaagtgaaaaagtggcataatgtttgtaaggctaaagaaatagttgaaatattaaataaaaagcattacaaagctcagtatgttgaaactatagacgaagcaaaaaaactgctttttagtatgatagaggaaggaagcagtgttgcccttggaggttcaactacattaactcaaatgaatgttgttgaaacactaagaaatggaaattataaattttttgatagatatcaagatctaccatttgatccagatataatagaaattcacagaaagtctttgagtgcagactatttaataagtagcacaaatgcaataactaaaaatggtgagctagtaaatacagattgcacggggaacaggattgcacctatgatatttggtgctaaaaatgtaattattgtttctggagtaaataagatagttgaaaatttggattcagcaatgaaaagaatacgagaaattgcaccgatgaatgcaaagagaataaaacatgaaactccttgtgctgaacttggatattgtgttgactgtgactgcaagaagagaatgtgtaattttacaagcataattcataatggaattaagtttgagggaagaataaaaattattattattgctgatgaatgtggttattaaaaaatgtgccatagagatgatatttggtatgcaactaatatagaaattatagattatatgaaggcatttgaaaatttgaaattttctatggatgcaagttttgtatataatccatcaattcaatctgtttggcttagtgttgatgggaacatagtagaagtaaagggccgacaaacagtatatatgtaaaagtatacatttaaaggtgacttattattttaattaaaagtagtaatactagcttaaaattgtttgataattaggaattatacttgactatttattattaaaaaattgttaaagttgaattgaaatttatagaaataaataaatttatgtacattattaagtacaaatatttggagggtaaacaatgaaaagaaaaataacttttatgaatatgattggttatgcatgtataaattttttaggtagtggatctcaagcaattatttcagcgttcttaatgtttttctatactcaatgttgtgatattgatccgcttaaggcaggttcaatatttacgattacaagattaatggatgctgtgttaaatccattagttggatctataagtgataactttggtaaaactgcaattggtaaacgatttggtagaagaagatcatttacattaataggtattcctttagtaattgtaattttcccaatattatggacaacaggtcattcgttctcattctactttgtaatgaatttaatttgggaattaacattcacattagtagtagttacgggtacaacattaccagcagaaatggctactagtgcagctgataaaacaaaacttgtatctgcaaaacaatattttggacaattttcaagtggtatagctactgcattcccagcattctttgcagcaagaatgggtgacgataatccaagagcttatttctttgcaggtgttacttatgctgcaataatggtgttatctttagtagtgttctatgcatttacttttgaaagagatcctaaagatgtccatgtaactgaaactaagagttttgctgaaacaatgaagaaaatgcttgcagatattccttcagcaatgcaaataaaatcattcagattacattctgcaatgatgctattaataggtatttacaaaaatcttgcagctggtgtattcacttattttgttgtgtattgtttaagtttatcaaaagtagaagcaggatatattacaggtgcttcacaaataatttctatagtagcagttacagttactattggattgtgttataaatttggtggaccaaaagcatttaattatggtgccgctgttgtttgtataacttgcttaggatttgttggattaactaaatttgaaggttcttcaatgttagtaactatgctagttgtagttgctgttgcaaacttcatgggaagggctgctttagattatattccagtattccaattaccatttatggctgatattgatgaagcagttactatgcagagaagagaaggaatatttactggaactaacggtttattatcaaaagttgcaggagctgttgaatcattcttattaggtgttatattacaatattcaggctttgttaaaggtgaagctgtacagccacaatcagctgtaacaactattacaataatgacagttgcggttccaatgatattattatttgtatgcttcttagcagctagaagattaaaattaactaaagaatctcataaattattagttgatgaagttaatagaattaaagcaggtggagataaagcagctgttactccagaggctaagaaagctatagaagaattaactggatatgcttatgaaaactgttttggtaacaataatgttggatatcatgaaaaaacagcacttaattcataaaattattagttaagtgaattactatctataataatctatataaaatgcagcaggagatttgtaagagtactgctgcatttttagtaagttcatctgtggaagagaggatttttatatgtttaaagaatttgagtggaatcaaaaactatatgattcaattgaaaagaaagttaatgaaaatataataaactttgaaaatatggacaaatataatattgaagatgaaaaatataaaaaatttattagtgatgttgaagaagtttatcttacacatccagatggaccttataaaggtgataaaaaagaacttaaaaatgataaagaatatataagtaaatctttaataaaaaatatacagattgtaaaatattatggtgatgtaatacaaaaagcaattgatgatgccaataaaaatggtgggggaaaagttataattccaggaggaactaaagaagaacctaaaatttattatagtggatcaataactttaaaaagcaatgtagaactttatattgaagaaaatgctattataaaatttttaagaaataaatctaatagattttatccacttgtatatacaagatgggaaggcgttgaaatgatgaacttttccccttttatatatagctatgaagctgaaaatattgctataagtggaaagggcgttcttgatggatgtgcagatgaatttaactggatgccttggaagtttgggtattttaatgaagaagatcagcagattcaaagggaaagattatttaatttgggtcaggaaaatgcttgtgtaagaacaagaagaatattcaatgatgaaatttcaacaataagaccaccatttattcagccttataaatcaaaaaatatacttattaaggatataacaattttaaattcaccattttgggaagtaaatcctgtactttgtgaaaatataaaaatagatagtattacagttgatagtcatttatataataatgatggtgttgatcctgaatcatgtagagatatgataattgaaaactgtcattttactactggtgatgattgtatagcaataaagtcaggaagaaataatgaaggaagaaacataggtgttccttctcaaaacataataattagaaataataagtttgaagatggtcatgggggaataactataggaagtgaaatttctggaggagtaaatgatatatttgcccacgataattactttgatagttcagaacttgattatccaatcagatttaagaccaatgctgaaagaggaggaaagcttgaaaatatttatgtaaagaatagtgtggtaaataaatccaagattgcagttatccatgcagatttcttctatgaagaaggaactaatggaaattatatgccaatactaagaaatattactttatctaatataaaaactgtagaaggtggaagtatagatgcaaataatgcattatttttaaaagggtttaaagatgctccaattgaaaatattttaattgaagatgtatatttaaatggagttaagggtgatgctgtattacagaatataaaaggaattggttttaagaatgtgtctataaacaataaaagaattgatgataagattatagatgttgaaaatgattttagagttaaggaatatagctttcaataaaaaatatatttctaaagttgcaaaagatatatattagaaaggctaaaacttaaatattaatttttttattgaactaaagtattatttaagtatataaatattttgaaagagaagaatgtctgaataaattttagacattctttttttatgaaataccttaaatgtcataatgtagtataattatctatgagtgtactattttatgatgaattatagatttatttaaataagaatgaaaaaagtaatcaaagaggtgatatattatgaaaaagccaataaaaagagcggcagtcatacatgatttatgtggtgttggaaaagcggcacttacaaatataataccagttttatcaacaatggaaattgaaacatgtccaattccaactataatattatcttctcatacaggtggacttggaaaaccagtaactataaaattagataattatattgaaaaagctatgaatcattataatgaacttgatttaaactttgaaggtatttttataggttatttaggtagtattaagaatgtagaagaatgtataaactattttgaaaatatagaaatgaaagaagagtcaatagttatatttgatcctatttttggggataatggggggtattatagcaattttaataaaagttattcagataaattaagagaagtaattaaatttgcacaaataataactcctaattatacagaagcatgtttattagcaggagaagaaattcatgaatgcttagaaaaaaaccatttatataatatatgtagaaaactatcaggttttggatgtaacaaaataataataacaagtgtaccactaggcaagggggatttaattggaaccgttgtatatgataatgaatatgattctatttatataatagaaagtttaaaacaagaaaaaagttatccaggaacaggtgatattttcacatctgttctattagggaatttgatgaatggaatagagctgttgaagagttgtgaatgttcgtgcgcgtttgtggaaaagtgcatgaaaataagtagccaatatgattatcctagtaaagagggggtattgcttgaaaaatgcctaaaatacttacgttgttaaagataaatgaaatataaaatttaatttaaatgattaagaactatgtgtttttgttataaaaatgaaaaaaagtgattatttttgaaagaaaatgattgatttattttaaaaaatgatttattattatatcagaggagtggtgataatgtttacagaggaaagatatagtatcattcttcaagaattaaatgctaaagggattgtttcagtaactgaactagttgagctgcttgatgcatcagaatctactataagaagagatttgaattcccttcataatgatggaatgcttaaaaaaattcatggaggagcaatttcaattggtgataacacttctaaacatgattataaagttaatgtaagaaagactttgaatacagaagaaaaacatcagcttgcaaaatacgcaggcagtcttatagaaaatgatgatgtaatatatttagatgcaggaactactactgaagcaatgattgattacattcaaagtgataggattcttgtagttactaatggtatagtccatgcaaaaaaacttctagaaaagggagtaaagaccttcatattaggtggtgaagttaaagctgtaactgaagcaatagttggaagcagtgctgtggacgaccttaaaaaatataatttttcaaaaggtttttttgggacaaatggtgtaagtaacaaaagtggatatacaactcccgatgttaatgaagcaatggttaaaagagaagcaataaaaagatgtatggaatcttacatactagcagatgaatcaaaacttgatgaagtaagctttataacatttgcaaatataagtgattctacactaataacaagtaaaacaaacgggaatagtaattatgatactaaagtgataggagtggaataatatgattaatactataactttaaatccttcattagattatgttgttaaagtggatagttttaaagcagatgctttaaatagaattaacagtgaacaaatttatgcaggtggaaaaggtataaatgtatcaattgttttaaaaaacttaggcgttgataatactgcattagggtatgtagcaggatttacaggtgatgaaatattaagacagataaaagatcataatgttgactgtgattttgttaaacttgaaagtggtatgtcaagaataaatgttaagcttaaaagtgatggagaaacagaaataaatggcgcaggtccagacataagcgaaaaggatttagaatctctttatgaaaagataaataagcttggaaaaggtgatttcttaatattgtcaggaagcattccaaagagtgttccagatgatatttatgaaagaataatgaaaagtcttttagataaagaagttgagtttattgtagatgctacaaaagatttattattaaaagtcttaaaatatagaccatttttaataaagcctaatcatcatgagttggcagaaatgtttaatgtggaattaaaaaatgatgaagatataatagcatatggaaaaaaacttcaggaaatgggagccaaaaatgtcttaatatcaatggcaggagatggggcaatattattacctgaaaatggagaaccaataaagagagaagtacctaagggaattttaaaaaattcagtaggtgccggagattcaatggttgcaggatttttatgtgggtatctaaaaaataaagatttagatgaagcatttaaaatgggaatagcaacaggaagtgctagtgctttctcagaagaacttgcaacaaaagaagaagtagaaaatttattattacaaatgaaataagttaagcataaagtaaattttatatgaatttgaatttttaagtgtcatgcataaaatgcgtgatacctaaaattacaattatagtaaaccttatcattaatcgatatcaatttaaggtagtaatttattttaaggaggaagaaaaatgagaattgtagatttattacataaacaaggaatgaaccttaatattaaaccatcttctaaagcagaatgtataaatatccttgttgatcttatggacaaaactggaaatttaagcaataaagaggaatataaaaaagcaatacttgctagagaggatttaagtacaactggtataggtgatggaatagctatacctcatggaaagacaaatgcagttaaaaaggcaagtcttgcagcagcagtatgtaaggatggcgttgattatgattctttagatggaatgcctgcaaatttattctttatgatagctgttccagataacagtgataatttacatttagaagtattagcacgtctttcaactatattaatggatgaagagtttagaaagaagttaataaactgtacgaataaggatgaatttttaaaattaatagatgaaaaggaagcagaaaagttcccagaagagcctcaaaaagatgttaaatcaggaagtggttcttacagagtattagcagtaactgcatgtccaactggaatagcacatacttatatggcagcagaaagtttagaaaacaaaggtaaagaaatgggagtttctataaaagttgaaactaatggttctggaggagcaaaaaatgttttaactaaggaagaaattgaaaaagctgaatgtattataattgcagctgataaaaatgttgaaatggctagatttaatggaaagaaagtcataaagacaaaagtagcagatggaattcataaggctgaagaattaattaatagagctacaagtggagatgcccatgtttataatcatgaaagaggaagtgaagatacttcagattcaggtagtgatgaaagtattggacgtcaaatttataaacatttaatgaatggtgtatcacatatgcttccatttgtaataggtggaggaatattaatagctttagcattcttattagacgactatagcattgatccaagtaattttggtatgaatactccggtagcagcatttttaaagactgttggtggtgaagcatttggatttatgcttccagtacttgcaggatttatagcaatgagtattgcggatagaccaggtcttgcagttggttttgttggtggagttcttgcaaagataggaactacttatgcaagtgcttttgattcaagtatttcaccaataagtggtggatttttaggtgcattgtttgcagggtttgcagcaggttacttagttcttggtttaaagaaggtatttgatttattaccagatgctttagagggcttaaagccaacattattatatcctttatttggaataggtcttataggactaatcatgatacttgtaaatccattcttcggttcaattaatactggaattactaatgtacttaattcaatgggtggaacaagcagagttcttttaggaattgttgttgcaggaatgatggcaatcgatatgggtggtcctttcaataaggcagcatatgtatttggtacagcatcacttgcaagtggaaactatgaagtaatggcagcagttatggctggtggtatggttccacctcttgcaatagcacttgctacaacattctttggaaatagatttactgataatgaaagaaaatcaggaataactaactatataatgggattatcattcataactgaaggtgcaataccatttgcagcagcagatccattaagagttattccatcttgtgtaattggttcagcaacagcaggtgcaatttcaatgatattcaattgtactttaagagctcctcatggaggaatattcgtggtacctgttattggaaatccattaatgtatcttgcagcagtaggtgcaggttctgtaattggaatgatattattagcattattaaaaaagccaattaaaaaataataaatagcacactcattttagtctttatatatacaatactgtatcagaagtaattttattgattgctctgatgcagtattttttatatccccaaaaggttccctaataaaaaataagttaagttattgttatagaaatagttcttcaatcatagaatgtataaatgaaatttatttataaggaaggtatattattatgagaagaatacagaaatttataataagtttttttatgacaataacatgtgttacaactttgccagcatatggatggacaagcgaggggaatggatggataaatggtaccatgggatggtcatatatgataaatggtatttatagtgatggatggaataacattgatggaaagtggtattatttttataaggatacaaactttatggcacatgataccataattgatggatattatataaacagtgatggagtttggatagagaatgcaccatatcctatagaacagataattaaaaatgataaagattatttagataatacatttaaagatattcagtggagcttttatactgatgaaaatgtaagtttaaaagaaatttgtaatgaatactgggatgttccagatattgttggaaatatgtattggatacaagatagagaaattgatttgttagggtattttgtaagtggagataatgtttactgtcttgcaaatcaaggtggaactgatatctataaaattgaaaacggtaagattattgaaagtataccctatgaaatttcaaatagttatagttggagaaaaatataatctaaaatataaaaatctgtaattttgaaaataattcaattacagattttttgttttatacaattaaaagtataacttattaatgatttttcgagtttttaaatacataacattaagttaacttgtaaacaataaaaactatgaaagtcaaagagttaagctatttacaatgacttgatgtgttatggacattgattttaaatatagccatatgaaaggttcgtaacaaataaaaaattatttcatttgattaaacttattttattagagaaaacgagggatgaaacatgagaaaaactaaaactatggatggtaatactgcagcagcatatgtttcttatgcttttactgaagtagcaaccatttatcctattacaccgtcatctccaatggcagaacatgttgatgaatgggttgcaaagggtaaaaaaaatatatttggtcagcctgtaaaggttgttgagatgcaatcagaagcaggcgcagcaggtgcacttcatggttcacttcaaagtggagcacttacatcaacatatacagcatctcaaggattacttttaatgatacctaatatgtataagattgcaggggaattgcttccttgtgtaattcatgttgcagcaagagctcttgcaacttcttctttaagtatatttggtgatcatcaggatgttatggcagcaagggcaactggatttgcaatgctttgtgaagacaatgttcaagaagtaatggatttatcgctagtagcacatttagcaacaataaagggcagagttccttttgttaatttctttgatggattccgtacttctcatgagttgcaaaaagttgaagtatttgatgatgaagaacttgcaaatcttgtagattataaagcacttgaagagtttagaaatagaggcttaaatccaagccatcctgttacaagaggtacagcacaaaatccagatatatacttccagacaagagaagcagtaaataaatattatgaaaaaattccagaagttgttgaagagtatatgggtcaaattaaaaaacttacaggaagagaatatcattgttttgattattatggagataaggatgcagatagaataataatttcaatgggtgcagttaatgatgttattgaagaaacagtagattatctaaatgcaaacaaacaaaaaacaggtttggttaaagtaaggttatatagaccattttgtatagaaagacttctcaaggttattcctaagagtgtaaagaaaattgctgtattagacagaacaaaagagcctggatcaattggagaacctttatatcttgatgttattaaagctttttacaaaaaagaaaatgcaccatgtataattggaggaagatatggacttggatcaaaagatcctctaccatctgatattgcagccgtttttgataatcttacccttgacgaaccaaaggatagatttacaattggaattatagatgatgtaacaagtacatcattaagacctcttgatatagatgcaacccctgaaggatgtacagcatgtaaattctggggacttggatcagatggtacagttggagcaaacaagagtgcaataaaaattattggtgatcacacagatatgtatgctcagggatattttgattatgattcaaggaaatcaggaggaattacaatttcttatttgagatttggtaaaaatcctataaaatcgagatatttagtagataaagcagattttatagcgtgccataatcaggcgtatgtagataaatatgatgttacaaagggacttaaaaaagaaggagtatttttactaaatacattatggaactttgatgaacttgaagaaagacttccatctaatataaaaagatatattgcacaaaacaatatcaatttttatactataaatgcagtgaaaatagcacaggacataggtcttggtggaagaataaacatgataatgcaggctgcattttttaagttaactaatatcattcctgttgaagatgctgttaaatatcttaaggaagctgtagtaacggcttatggtaaaaaaggtgaaaatgttgtaaaaatgaatcatgatgctatagatgaaggggtaaacggaatagtaaagataaatataccaagtgattggaaaactgcagttgataaaagcgataaagagaaatttgaatatccagaatttataaataagatagtagcaccaatgaatagacttgaaggtgataatcttccagtatcagcttttgtaaattgtggaatggaagatggtacatttatgcatggtacaacagcttatgaaaaaagaggtgttgcagtaaatgttccagaatggattccagatagatgtatacagtgtaaccagtgttcatatgtatgtccacatgcaacaatacgtccatttttattaactgatgaagagaaaaataaagcaccacaagggtttaaatctgtaattccaaaaggaataaagagtgaagaacaattaaattatactattggagtatcacctcttgactgtacaggatgcggaaactgtgcagaggtatgtccagcacctggaaaggcgcttataatgaaaccacaggatagtcagcatgatcaagttgaagtatgggattatactgtggaaaaagttaagaataaaaatcctatgaacaaatcaactgtaaaaggaagtcagtttgaagttccattactacaatatagtggagcttgtgcagggtgtggtgaaacaccatatgctaaacttgtaacacagttatttggtgataagatgatgattgcaaatgcaacaggatgttcatctatatgggcagcaagtacacctgcatctgcatattgtacaaatgctaatggccatggaccagcatgggctaatagtttgtttgaagataatgctgaatttggacttggaatgtatgtaggagcaaaaacaatttatgaaagaatagctcacaatattgaacttgctttaagtgaagatatagacgatgatacaaaaataattcttaaagaatggcttgaaaataaagatgttcttgagggaagcagagaaagagcagaaagagttataagtgtgttagaagaggataatagcgaatttgcaaaaataatccttaatgataaggacttttttgttaaaagatcacagtggatatttggaggtgatggatgggcttatgatattggctacggaggccttgatcatgtacttgcaagtaatgaaaatataaatgtattagtatttgataccgaaatatattctaatacaggaggacagagttcaaaagcgactcctactggtgcaattgctaaatttgcagcaagtggtaagagaacaaagaagaaagatcttggaatgatggcaatgagttatggatatgtatatgttgcacagatagctatgggagcagataaaaatcagacaataaaggccataactgaagcagcaaattatgatggtccatcacttataattgcatatgcaccttgtataagccacggaataaaaataggaatggcaaattctcaagaagaagaaaagaaagctgttgaatgtggatattggaatctttatagatataatccagaactaaagggaagtgagaagaatccatttactttagatagcaaagatccaaaatctaactttaaagatttcttgatgggtgaagtaagatatgcatcacttgcaaaagcttttcctgaggaagcagaaaagttatttacaaaaactgaaaaagatgcagaggaaagattgaatacttataaaatgtttgcagaaaataagtgatataaataaaaaataattaataggactgatagggtagtttcagtcctattaatttttaataataagtcagagtgtgatggggctctggctttatattttttgttgggtttataaggtagtgtaatataagtttatttaataataagataatgatataagacaggactaaggtttatttacaataagaaaagtaataataaagggaaaaaccagttacagcctccaccaaatccgccatatccataatttccatatccataataattattatatccacagtaattattgtatccgcggcaattacagttacatctgttgttgcaacattgattatttattctacaacaattctttgacattgaagatacctccttagaaatttaatatttctatactgataatatattcaacataacaagatgtgttacacacttatgtgaataattaaaaaactattgcaatatgtgttgaatgttattgtacaattgctataaaatactaatgacaggtaatatgtaatattattattacaagtaaaagaagtttaatagtaaagtaatgttatgagaaaatcatatattgaaatttaataaatagtaagaataatatttatatgttaaaaaatttaaaggaaaaatttgtacttaattgaagcttagatataattaatatttattgggttgattaattgtaaattataaggaggcataattatggaatggtattgtgcggtatttaatagtgataaagtaaatagtgcaataggagcacaagttttatatgagagattatgtgaaggtgatgaatctcttgtaggtgatatagaaataatagatgaattttataatgaacttatgaaaaaaacaaaagctgtgaagtgtaataaatgtagaggatatattattataagcactgaatttgaaaatgcagaatttataaatgaagttgtaatgaaacttgctaaaaagcatggtttgtcattctatgaaccacagaatatggtttatgtattttaagatttaacgaggtgataagaatggcagtttatgagttgagtaatgagcttatttttccaaatccagagcttggtgaagaggatggacttctggcttttggaggagatttgtctatggagagacttcttcttgcatacagtaatggaatttttccttggtacaatgaaggcgagcctataatgtggtggagccctaggcctagatttataattaaacctgatgaaattcgcatttcaaaatctatgagaaagataattagaaaaagtcagtttaaagtaacgttcaataatgattttgaaggtgtaataagtaactgtaaatcaatgagagagaataatgaaggtacatggattactgatgatatgaaagatgcatatataaatttatttaagaatggatatgcagttagtgttgaaacatatttagatgatgagcttgttggaggactttacggtgttgtaataggcagatgctattttggcgaaagcatgttttcaagagtaagcaacgcatcaaaaatagcactaataactcttgcagaagtgttaaaagaacagaaatttgaattcattgattgtcaggtatatactgaacaccttgaatccatgggagctaagatggttccgtttgatgaatttaaggctatgttacataggggtatttatgattagggttaaaatatatttggtattttaatccatgatattatccaattaaatggtaacgtcaaaaatccgtcaaaagtcaaatttaacaaaaatgtgagtactttcttgaatgcgttttattgaaatactcacataatctgattaattattttagcagctttttgaatcatatcgtcagtaacatggctgtatgttctcatagtcatttcaactgtgtgcccaagtaattgggcagcagttttaaaatcaataccatttgatattaaaagagtagcataggtgtgtcttaattcatggatgctgatttcatatccaacttttctaaagatcctctgaatattacttcctacaccattaacgctttttaagcgcacaactctattatctatatttcttggttttagtgaatcatattgaatcagtgctttctttacagcaaggggaagaggaacatctcttttagaattaagtgtttttaacggaccaaagccgtaatgttctttttcatcaagcaatttccattgctgtcttaccaatagaacattatttttaaaatcaatatcactccattttactcccatggtttcaccaagtcttaatccacatttaccagcgaaaagtgacataatataaaactcttgatattcttttattttggacattttaataagaagatcttcaagttcagcaattgtaagagctcttttatccaatggatctttatttccttgaaaaataatatttcttgctggatttgtaatgataatattatatttgtttatagcagcatttaatattgattttacttttgcaagatatgattttatactgctatgctttaagttactttgtacaaggacatctacacagttttgtatatggaatggcctgagcttagaaatttcaatatcattgagatcctcaaaatgtaataatgagagtttataagcacgtattgtttttggctgcatatgtacagttaaatgttttatatagatgtcacaaaaatctttccatgtaatattttcataatctaggttgatatcatttgcaagattattttttattgtctgcaatgtttcatctgcccattttttagcttttctctttccttctcttgaattggggaagccctgtttgcttttctgtttccattttccaagttctgttttataagaaattatagcctgcaaaccagcatttttttctctataagtaatgttatattccaaaatatcaaatcctttcgataatcttgtttattttttatcatcagatttattagcaccttcatccaagttgttacaaagattatgaataattttaattatctcattgaaattatttgcaaaaacctctgcattaattgctttatcagtacaaatatatttgatattacagtttaaatcattactatattctataagtttatttttaccagaatcatttaatttattaaaattttcaagtaataattcttcgctctttgtaagatttctattagttgaaactagattttctttattcagtccaagcaatatttcaggatcaatttctaatgcatctgcaagtaactgaaatttatctaagggtatattttttattgcgccactttcatatcgttgcaatgttgatttgcttaatccagttttagatgctaaatcctgataagagagttttaattcaattcttctatgttttacattttcagctatgctattaattttatctatatgtttcatataatcatctcctatacatatattatcaaatattatttcatatatgcaatagaaaatgtgaaaaatttgcaaataagtataaataaggttgacttaatgttgcgtaaatgatattattctttttataaatatgcaacgaaaggaggaaacttcatggattcatataggttaaaagggaaaatgattgagaaaaaatatactcaaaagaaaatggctttagaattagggataactcaacagagcttaagttcaaagataaataatcgaacacaatttactttgaaggagatagttcatattgtggaaaaattggagttagaaaatgacttggatatctttattgaaactaaaatatcaaaaatgcaacgacaggagaataattaatatgaatatatttagatattctattagtatgaaatatattaaagtagattaattatataaaaattattatgtgtttgaggggtattatggatgttaaattattatctgtaaaagatttaagcataagatggcagaaagatgaaggaactataagaagatatattaaggaagggattttatctccatgtaatggagttccaggaatgatgtttcatcctaaatatatagcagaactagagggtattcagatagaaaaattttcaccattagaaaaaagacgtcttgaaaatgaaaagaatgagttgcagaaagaaaacatggagctgaaggaattattgagagaatataacatgataagtgcaaagagtttaaaagtatttgtaatttgagtagttatataatttatattataagaaaccaagataggtcttaattattggaatatgtgagcaacgataataatgataaatttaatgaaaaaaagtgtagttcagatacaagtttttggaggattcacaatggattttaaaatttttacttattatatattagtatgtaatctaattgaaattactccatcatttaaaggattagcacagtttaaaaagttttatagctgggagtgtgagtataatggcagatgcaaagtggattaaaattgcaattgatatgtttaatgatccaaaacttaagataataaattcaatggaagctaaggacttgataaattatgtatggatgagatctttattacttgcaggtcaaagtaatatgaatggatgtttatatataaatgaatcaatgccatatacaatgaaaactctggctatagaatttgatagagcttttgaagaggtgaaacttgcatttaaggtattaaaaaaattagaaatgcttgaagtaacagaagatagaatatttagagtaaagaattgggccaagcatcagaatgttgatgagttagaaaaactaaagaaacaaaattgtgatagagtggccaagcatagggcaaagaaaaaagagagtgaagaaagtaacaagaagaacgttacagaaattaatatagatgaagataaaaataattctgagattattagtacacaaaataatgatgatatacaggatgaatttaaaggaactacaaatgatattaattgtgatattacaggtaatgttacggatattcaaagtaacattaccgtaatggaacagaataagaaagagaataagactaagaagaagaataagacagatattgaaaatagcagaggaattgataatatagattcaaataatcctgcatcaattgctgaaaaaaatgattctcaagatactgggacagttaagtctgaaaaagaatgcaattcaattttgagtacagctgctataaagttactgcatcattatgaacaggttactggaataatgggaggtctagacattggaagtttaaggcttgccatatctactcatggtgaggaaaatgtgagaaaagcaattgatgaggctatagagactggaaagactaaggggaatatgagatatatcaatggaatacttagaaactggagaaaagaagggtatccagaagatgatgtgggaggaataaacaatggggcaaagggaaatggaaagggtagtagagcagattcaaaacaatttaaaggaatcaaaccaaagaaatgcagagagcttacggaagaagaaagaaaaaatcttggagcagctctcatataaatgcaatagatgcagagatactggatggattcttaaaagacagaatcatgcacagcctctggcacttcaatgtgattgtcagaagaaggagaggattaaagatcattggaaatgttgtggtattaatcctgaaatgattaactataaatttgcaaattttgaagtgtggaatgattcatcaggaaatatgaaagatactgcaacagtttattttaatgagtttgatgagattagagataaaagaagaaacagcattatgttatgtggacaggttggtagtggcaaaagtcatcttactatagcactcgccataaactttttaaaaagaaaaattgatgttatgtatatgccttacagagatgttatcacaaagattaaacagaacatgattgatgaagaatattatagaagaagtatttcaaaatatcagacttgtgagattcttcttattgatgacctcttcaaagggaaggtaaatgaaagtgatattaacataatatttgaaatcatcaattatagatatttaaattttatgcctattatagtaagtagtgaattttcagtagataagcttcttgattttgatgaaggggtagggtctagaatttatgaattgtgtaaggactatattgttgaagtagaaaaaacagtacttaataattatagattgaaataaataaattaaataagtgtacaagcaagtacatgatatataaaaggagagattgatatgtttggaccagggattataagaaagttagatgatttaggaagaatagttataccaaaggaaataagaaaaaggcatgaaatcaatgataaagattttgtaacaattattgatgcaggaagtcatgttattgttaaaaaatatagaaatggttgcatattctgtggtggtgaacaagatataagtgaatataaaaatttatatgtatgtagggtgtgtagaaaatccttgaataaataaaaatatgagaggtgatgttatatggagaacaataatataataaatgtgtttacttcagaagaatttggggaagttaggacaatactcaatgatgatggtagcatatcaattaatgctgaagatgctgcaagaggattagggtgggtacaaataaaaagtggtaaagtctatgtaagatgggaaactgtaaatgcttatttaaatgaattacacttttcccaacttgttgggaaagatgattatattcctgaatcattattttatctacttggaatgaaagcaaataatgaagcagctcaagaatttcaaaagtggcttgcagtagatgtgcttccacagataagaaaaaaaggaagttattcaattagtgatcaggatatgtcaccagaacttaaagctatattttgcatagataaacgtacacttgaaattacagatagagttgaaaagttggaaaataatatgactattgattacagtcagcaggaagaacttagaacattagcaatcaagaaagttgttgcaatacttggtggaaagaatacaccagcttacaaggaattaaataaaaaagcatttagtagtatatggcgtgactttaaaagagttatggatgttaattcatataagaatacttcggtaaagatgtttcaagctgctagaaagataataattgaatggcagccagatagggaattggaacttatgattaagggagctaatagtgttataaaataaattataggattatatggatgtaagtaatagacttatgtccattattttgttaaatttaactggcacaactagtaatataattaaagatataaaaatgacaccaggcttacgcctagtgtcatttttattgtgacaactattcagcatcaaaagttgtgatttttctttcagtaagcttagcctcaactttgcttacataagcaccattctttgtctcaaagatatcattagcaataatgttatccataagagcattagcctgctctgaagttacatcttccttaacaccagagatagtaagagaatttttcttaccagtttcagtcatgaaagttaaagttaaaatatattccatattaaatttcctcctcaaaataattttatagattgtaggttttaaagataatcaatagattatcaactgttcataattaatacccacaaggggtatcaattgaattatccttgtactaacttatcacttacagtcatatagacatttctagtttcatcagctaaaactgatttaactgcatttgcaacagtaagtaccttttcaggatctgcaccatcttttacattagaaaaagattttttgctgtaagtaggattaccaagtaaatcagtaccctttcttacttcgattgcaaaacttgcactgtctgcgattttattaactgccatattacattacctccttgaattaattttcattatgtatatatggagaaataaaaaaagtggtacatgtatgtttaaaagttctaatatggcaagtaatataaataataaaaaagtttataggaggatttatggaagagatgttaaatactttgaattcatttttatttatagggtttttggttgctatatttattgcaggtggagctgttggatatatgattggttttttaaattgtagtaagagttataagggattaatttcttatgttgagaaggattttattaaaaatattaagaatgatattatataaaagtaaagagaaatcaaaaaagaagtcacatctaccttgaatatagagcctcaatgaatgtatgatatataatgttatgatttatttggcctctatttaattagaaataaaatgagaagattaagatatgatatataggtacttatattttgtaatttaatctaaattacaaaacaaattaaaaataatataagtaacctaaagaaataaaaacagaatatggagtgtagatatgacaaataaatcatttatcttaacattaataattattttaaattttaggttactactaaagtatctaaaaagaaagattgagaaatatttctttaatataggttaccaaaataaattaaaaataaagataaataaaaaagaagtcacatcaaccctaaatatagaatccaaatgaatgtatgacatgagatatgatataaatgttatgatttatttggattctatttaattagaaataaaataagaagattaagatatgatatatagggtacgtattttttatctaatctaaattacaaaataaattaaaaataatataaatgaagaatagttgaaaactagtaaaatagggctttacaacatattttaaatgtgatattattaaaaaaataaaatctagatgtacataaataatctagagaaaaaatagaatatggagtagtagatatgacagataaagtatttattttatctttagtaattcttttaattttcgtgttattgctaaaataattaaaattactaaaatgattaaagtaagattaaaaaatctttctttaatctagtttaccaaaataaattaaaaagaaagataaataaaaaaggaagtcacatctaacttgaatatagaatccaaatgaatgtatgacatgagatatgatatataatgttatgatttatttggattctatttaattataaataaaatagaaatgctttaaagctagtaaatgagacagcattacaagagagttaaagtaagtatttatacatgaaataaaaatagaataagaagattaagatattatatatacggacttatatttttttaatctaatctaaattacaaaataaattaaaaataatataagtaacttaaagaaataaaacagaatattgagggtatatataacttataaatcatttatcttaacattaataattattttaaattttatgttattactaaagtatctaaaaggaaagattgagaaatctttctttaatatagattaccaaaataaattaaaaataaagataaataaaaaagaagtcacatcaaccctaaatatagaatccaaatgaatgtatgacatgagatgtgatataaatgttatgatttatttggattctatttaattagaaataaaataagaagattaagatatgatatataaggtacttatctttttaaaatataatctaaattacacaataaattaaaaataatataaaattaagaatagttgaaagctagtaaaataggggtttacaatacattttgaatatggtatgatttatttgcttaaatctagatttaagtaaataatatagaaaaataaaaacagaatatgaggtgtagatttgactgataaagtatttattttatctttagtaattcttttaattttcgtgttattgctaaaataattaaaattactaaaatgattaaagtaagattaaaaaatctttctttaatatagattaccaaaataaattaaaaagaaagataaataaaaaaggaagtcacatctaacttgaatgtagaatccaaatgaatgtatgacatgagatatgatataaattattacaagagagttgaagcatatgttatatctaaaattaatttaggtgttattagtagtgtaacttaaggaattaaagttgggttgcaaaatagtttcttaatctaaattattaaaagaaaataaaatgagtcaaatggactatctgcttgtaaagtatatgtgtaaaagaagtatacttaatcagaggtccatttcttgtgcttttaactcacttcacatattcatattatgttcggacaaaggattaaaataattctattgtttgtgtagtcatgttgttttagtctgcattattttgcaggctatctttttttattttacttataattattttatttatttctaactcgctatgctcagacaaaggaaacctttgagctggtgctcaaagcttgatatattgatgaagctaaagcttcattaaagcggatatgtattctaaagtttactttaatttttaagaaatatatatagaaacttaaagttaattcattatagtatccgatataggtgtatatggtatacgtgatttttaaaggacatgttattttattggtaatattaaagaagatcctttgggcgctttaaccaccacccgaaaaagtactggttattagctacaatttctaagtccacatttcttttacggcaagcttcaaagaaatattgacaaagaaattctatgcattaaactagttctttttagggtacccggtggagcgcatcttggcactatagtaatagatgcatatgcatgtagtaggatatgtattattaggaaatatttaatgaagttaatgttttgtgctgcacatatacttggaatatagaactttgtattctttatatggtcttaaaggcaagtacacttacgctaaacaagacgttgttccgataatatacaagccataattatttataaaaatattaaaagaaaaagttgttaaaaatgaaacttaatattgaaataaacttataggcatgcatacttcggaaaactttgtttagcgaaatgtacatgccttatttaatgtaacacttaaagaagataatgttttctgcttcaggtatgtagtgaaattataattttgttaatcaatgagacaggacttgtctcacttcacaattgcactttcaatgtcctgcggacctttacagtagcattgttacataaaacaagtcccgtaatatcataattttagtgttcaatattaacgcactacgtgtaggcggtagaggttggggggcttggagttgctgtaataacagcagttccatcttgtactagcaggagcagtccaccttcatgcataatgcctcttactaagtcaagctataccattgaccatatgtggtattcctatatggcagtcaaaggcatagcattgtttcgtaagagactttttatgcatttcagtatacaagctccagcatgtacaagaacgcccccggattttacttctaacgttttaatacaaaatactgaaaaggaattttaacacttgaggttacggtgcaaggcctgccggcagcaaggaatttttagaataaattattgcaattaaattaggaaggttagagagtttgaaattagatcatacacactatgcagaaattgcgaagaaaggaatttgaaaaacatgtggggagaattttgtgaagaacatcatcctgttggaaaaggatatacagagaatatggaagaatctaaaaaacatattatagaagctgtaagagctttaagaaaaataaagtgtgaatgtgataatacaacaacttgtgataggtgtgttgttattttaaaacttaatagcattcataatttttttagtcaagattagttaaaatgcagatttgacgaagtaacttaaatgaaaaatgatctttgaaaattgaatagtgttatattttacctactatgttacaattatagaaaatatattaatgggagaatatgtatgttgtttgttatatgtggtattattatgccaatattatttattatctataatattatttattatttaaaaagaaaagtaatttacacaataaaggataagaattttattataattgatgatagattttttaaaatacagctaagtttaagcttagttaatgcaatacttgtatcaatagtagtttatgcctgggataagtataatttaaagtttggtttattattttttatgttaatttactggggaattaattactcaataaaatatattggaatattaaaaaaatatgctgaaataagaaataatatataatataaaaatatcacactattcattttctaatttgagtagtgtgatattttttattacacagtacttatattgcatatattgagaactggttaagagaaaatgttctttgaaaattgaataatatgatttttacaaaatatgttataattgatttataatagtattataagacaagttgctttaatttttaaactgctagataaattagaatttgaaagagggtctaaaagtggtagcatataaaaatagagaagaactaattttagaaatttcaaaacgagcaaaattatttattaatgaatttgatgatatctgtgaaaaagataaagataaattcattgatgaagtagatagaacaccagctcaaatgattgcttatcaattaggttggatgaatcttattattgattgggagaataaagaaaaagaaggacaaaacgttataacaccagatccaaattataaatggaataacctgggtggattatatgaagatttttataatcaatatgaggggtatagtttagaagagctatgtattagttttgtaaaaactgaagaaaagattattgaattaataaatacatatacagatactgaactatttgaacaaggaggacgaaattggtcatcatcgatgccctctaattgggcaatatggaagtggattcatataaatacagttgcaccatttaagtcatttagaacaaaaatacgaaagtggaaaaaaattcagcaagcataagagtgataaattcaaatttgtcgtttagatattaagaacaattttttatattatgaatcaataaaattaaataacaaattgtaaaatcatattattcaagagcgtgaatttgcgatttttttagtgcgcaattctttaaattatagaattaaccttaaacaaagatactttagggcattacaattatagcagtaaaaaaataaatgttataaagggcactcacatgcgttcaaccctttacaatatttattttttatgcagttttattttctgccccaaaagcactatatggcttgtcttgtaatatgggtaataaatcatagtttatgtagtagttcataattattatctgaattaacataaataagatagctgaaaacatgcagctatcttatcggatcttatatgattaaaaagaaaaattgggctatattataattctagacagattaaattattttaaacatattaggtgaaaaatatagaatttattttattaaggggtaagctcttttactttatacttaattcaatctgttcatatttttcttgtgggtgagtttttatatagtatctgtatttttcaatataataagactttacttttctttttccatctggtggcagggtatcaagtagtgcttcaaaataatctcttgaaataatgctttcttcattttttaaccattcattaaaattcatattctcaaatcccttcattgttatatagttattattcccactagggaatttttttatgcacttttatgtatagaaattaatgaaagtggaaataatataaataagggagaaatattaaagagggaataaaaggagctgaaatttatgagtttattgagttttgatttaatgcagacagaattaatgtatgaaatgcagtattttgatgaagaaaaacaaggtgttataacatatgagtatttttacaaagatttagagaatgatggtcaatatatacttcatttagttcctggaacagtaaatgaaaaaatgataaaaatgtcacattatttattttttgaatgtggtgaaggtgcttattatatggatgaatttaattttaatgtattagctaagaatgctcaaagacaatcaaaatgccatccaatgaattgcaaattcataaactatgaaacatatagaaaaattgaagagtggaaataataaaataagatgtataaaaagttgagataatggaaacactacaaatagggaagtttattaagaggggtacaaaaaatggtataaaagaaagggttgttcaaaatgaagtttgatttgaaaaattcaaaattattgtttgaggtaagatacaaaagtaagagaagtgatgaaatttatacatatgaatggctttatagaagcaatgacggaaaatattttatgcattttgatggtggtaaatatagtgaatatgcagtgaaaatcggatattatgattttgtggcaagaagcgggaatttctttatggaaaaaattaatattaattcatggaaagaatcagcattaagttgtaagaagaaatggcctgaagaatatatggttattgactgggaaaaagaagaggatgaagcaataaccgatgaaataaaattaaatgaagagtatatgatgacaataggagatttagcagaatcaagattgccattttaaatagaggagcagaagctccttttatttatttacagaattatgaatgacggctgcattaagcattaaaataaaaaactaaaaggacaagctataagcataattatccttaaacttcctatcacctaaagaatgaagcgcatgaaaatgtcaaaggtgtgcaagcatctgcttgtacaattcactttcctttgacattttcaggagtgaaattacaatgctcatggaagtttataaaataaaaagaataatatagtgttgtataaaaattataagataattccttgctgccgcaggccttgcaccgtaatctaatgtgtaaagatttctttttaggatttagtttttaaggactacaagattaaatttgaagaatactagtattaaaaaagatagattccaaatttaaacttaataatatatgatattattaaatatatatgttgagttaaggggggaagtaaaacaatgaaaataatatcaatgataaataaagtcatattatcactaataatttcatcggtagtttttttgacacttaaagaaagtgttgatataaatatgtacgccacattaactgtattaatattaattcttataggtataaactttaatatgaaaaaaagtagagatatgtatgatacttttgcagctatttatttaggaactacactctctttcttttgtataaaaatcatatggaatattaatagtatcgatgaattaaagaagtcatgtttaaatatttcttggatagtagttatagtagttatattatgtatattagtatatttatttattggaagttttatgggaaaatctaagaatagtattgacttaactttagagttaataccaaaacgaaagaatgatttagagcgaattgtagaatatttgactagactaaacatagtatgtcttaatgctaaatggggtgatggtaagacttttttggtgaataatctaaaagaacagataaaagatgactatgaaataatagaaattgatgttttatcctgtaatcttgaagaaatacaattagtattaattaaagaattagaaaaagttatgattcgaaatagaatagcttctaaatattctaaaaaacttagtgattttttgggcagtgaatttcgatttaaaagtatgtggagtataaattttaacgaaaatatatcatacttggacatgataaatggatttaaaaatgatttgaaaaatttaaccaaaaaaaaagttttaattatctatgaagatatagataggataaaggatatgcagattattaaaaatatattttcaatatctgaaaaaatttcaagagatactaataatattaagatattatatcagtatgatgagaaaaatttattagatattggatttaagaatgattatttagaaaagtatatgccttataagattaatttaacaagattgaacttttttgaggtattaaaatttgtattagatcaaatgaaaattgaggagaatatactaaagtttaaagattttgaattcttaaagtatagtcaacaaattggtaattttaatatattatacgaatgctttaaaattgaaaataatagtactattaatattcaaaactatagtattagaaaagttgaacatttttttaatgaaatcatattttatctagataaaaataattcttgtgaaaatgactcggaaaaacaaataataatagtgttttttattctaaaacatttttttatggaagaatataataagattgagccatttaaaagcatattagatacaattaaatttacagatagagaatcaaaaaagtattcaattatggacttaatttctttatataaatctggtgaaattacttatacatatattaaagatatttttaataatcctgataatatagaaaagtatactattattagaatgtttaattataaaataaataatgatgaaatagaaaatgataatatttttaataaatcaactaaaaaattagaaaatgaagaatataatgaaaaaattgataggattatttggaatcttatggagagtggtaggtcaaacaaaacggataatgaagtgacattggttgaattagttaatagagtactaaaaaagcctaaagaagaaagaaaagaaggttattttgaatttgacaattatttttctaatttagattataatgaagtagataatgagaccacatcatttatgggagaacctcgattttcacaagcatttagggctttaagtttgagtaaagataaagataaaattttacaatatcaacgaaagttaatagatttatattttgaagctgaaaagatagaagagcaagctgtatctaaaaatgtactaagaataatgaagtattggagtttgttcaatagagatgaatatacttatatattaaaaaggttcaataagatacaagtaaaaggaaatttaaataatgatagggagtttattgactttattgataaatatgttggagctttatcaaagcaaagtactaaatattgtaatactcgtggtttaattaatattagaagtttaaataatattaatgaaaataaagctataactctaaaaataattaatgatataaaagaagaaatagttaaaatgggaagaaatataaaagaatatttaggtgattttataattatagatgaattaaatgtaatagaagaattccttgataaactaatatgtataataaatcaagaagaagaatatatgcataagaacaataataattatagtataaataatgatgtaaataaatttttgaattttaatgatacatgttttttagaagatataaaaaaagaatactgtgaacaaaatatagatgcatacacattaaacagagatataaaagaatataaaagaaaattgaaagaaaagagcaaaaatgattaatatatagaagtgtattaattaaatacaaatgaatacttgaataataaattagatataggattgaattttaaagcagtaaatagtttattaatatttgctgcttttcgttatgtacaatattcatctaattatgatttaaaaccatataaagcataattccttgctgccgcaggccttgcaccataaaataacgtgttaagacttctttttaggatttagtgtttaagaattagaagtttaaaaagctgggggcggtcttgtacacgcaggcacgagtccatatattagagtataaaaagtcattatggagcaatgacttacctctgccatccctagaggaataccacaaaggggcagtggtatgtcttgacggaataatggcattatactcggatgtggaccgcttctgccagtacaagatggaactgctgccctggtagcaagtccaagcccccgccaccataacgcctgcacgtagtgagcatagaattaacacttacattatgattttaaatgcttgttatacgtagtaatgcatctggaaatacatgcattggaagagcaattacgtagtaaaacaagcattgactcattgattcacaaaattatgattacactacagaacggtaaaacaggacattaatttttataagtaatatatagtgaaacatatgcctctgcatacatatttatatgtatctatctaactagtgataagactgcaccccatcgggacctgaaaaaggactagtttaatccttttgtttcttttgtctacatttggcttgtgaacacttgcagcaagacaatatgtggacttaggaaacagaggtaataacctgttcttttgtgggtgatggttaaggtgccaagagaaatagtataagtatatatagtaggtatgtaagtaatagtagtagcttcaatatcaacaaaacttgccttttaaaaattacgtataccagatacattactatatagagaagtaaatatttaaatttaatacaaatgaatctattaaagagaataaaattcttaagtattagtaatttgataataataattagaacttaatgcagtctttgtgggaatgaagcggcagcttcatcatataatgagctttgagcgtaagctcaaaggtttcctttgtgtgagcatagccagttagatttaaatgaaataattataagtggaacaaaaggagaaaagattatagatatttaagagaaaattagaataataacaagtaacattagaattatttcaatccttttattgttttaaaaatatgaaatttcggctataattaaagtagaaagctggtgataactatgagtaaagaaggcgatgaaaacagagtaaaacttgatgaagttctgaaatcattatttaatgtatctaaaaaagttcttattgaaatgatgaatagtctgtttcatgaaaattatgatatagatagtacagaaataacatttgaaaacaatgaatttgttactgatgattacgatataatcagaggtgatttatttttaaagatatctaatgataataaaccataccattatcatgagcagagaaccaaatctttgatttgtgtgaatcgcttacacctatgaacatatgtgaatagtgtgcttcttttttatatagacgaagaatgataagacgatggttattagaatgtttgaatatggctttaagaaagctaaggaactttcaaggtgtgaagatagttcagatgatgaaactataatatatattccaaagcagctggtaatgtttattgaagaaaacaggaatattaaagatgaattaaaaatgaaacttgtatttccagatggtcagattgtaaattataaagtaccagtattaaaatgctgggaatatgatgataaaagattcatagaagaaaaaatgtatccacttcttccacttcagatttttaagctaagatatgagatggacagcatcaagagaagaagtaatggtgataagaataaattaaatgaagcaatacttaatgcaaaagaactggctcagattgttgcgaatgaaagcaaatttctttatgatgaaaaaaagattgatggagaagatttacataaaattctcctagctataggtaatttatttgaatatttaaatgataaatatggtgatgataaaaagcttaatgaggaggtaatgaatatgactaaaactttgtatgatcctgaagttgaaaaaagaggaatagaaaaaggaatagaaaaaggagaagaaaaaaaggctattgaaacagcaagaattgcaataaaaaagggtcttaatgatgaccttataagtgaattgacaggattaagttttgaggaaattaatagtataagacagtcggctagtcattaagaagttttgtatggcttaatgagaaggtagttaagatgactaagacattatatgattttgaagttgaaaaaagaggcatggaaaaaggtgaagaaatcaaagcaaaaaaatctgagaaaattttctaaggcttggagtaagtgaagaaatagtggtacaaggagtaggactttcaatagaagaagtaagagaaataaagagattacttattcattaagattgactttaagtagttttgaatatataaggtaaaaagatagtaaacaaacagaaatgatgtttgtttactatcttttgttttatgcaacatttccagaatcattcttaccatctttgggatcaataacaactccaagtttagtggaaattatggtatttagtttattaattgaagctgataatgaactaagctgtttttctagtcttattagcagatagcagctaactgcaactggaaagccattattcactataagatttattaattcattaatttccataaaaatcacctcctgcaatgtatatatgtagaagtgaaaattattggttagaatcatataataatcagatgaaaataaaacaaacatttcaaagtgttggtagttatgaagtctttgttcagtattccaagtgttgaaaatattgatatacataaaaaatactactttactttgactgcataagaataaatattaacatacataaaaagcttgtctaaaatatacctcttctttttaacggcataagaataacacatacctttttcgtcagtgtatgatttcagtgttttgttttcatagaataaatgatgtataaggtcaatttcatcttcagtcaatttattaagtgcatatttaaggcaatcagaatcatattggctacataatgtatctgtaatttctggagtatcagctttataggtttcctctacataattatcataagcagcagttccagatccatgaatattattagtttgtatatttcttcttattaaatcattgatactgttttttatgccgttagtagcataagcaacaaatcggtgggattctattttataaagtagaatgcatctaaataatattctgtaacattcgtttttaaaatcatcatagtcatatccagggatgaaggttctttttgaaagattaattataaaaggcctgaattcttcaataagcttttcttttgaagtttcatcaccatctttacattgtttaactaaattttcaatataatcgtaattcatagaaaacctccagaaaatataagattatagaggtaaaacaaatctacaattgcagacataaaatagctctatacatgtatatatgaagaaatagaaaagttttcttattcaaatacttaaaatacatgataaacgggcagttcttaattgtatcatatttagatttgataatttaagatagtatcagacaaatataacaaattacttgactaccatatatacaatatgaaaatcaatagtatatatggaggtattttttttatgagcaattttgttatagctgcaggtcatactgcaagcggaaatattggatgtggagttgttgcgaatcttgatgaaagcaattgtactagagaaatttctcaacttgttgggaaagaattgaaagatagaggttatggagttacattattaataattgataaaggtaatggctatacgtatgaagattgctatgttagggcagaagaagctaataaattagctaaaaacagtaagattgatttatatgcagagattcatattaatgctggggaggaactggtacagaagtattgattactaatatggttgattctcttatagcagagaaatatgcagaaagaataagtgcatcagtatcaggaactttaggaataaggaacaggggagtaaagaagcaaagtcttattgtattaaacaaaacaagtatgccagctatattaattgagtgcctttttgcagatagcagtgatagtaataaatataatgctgagataattgcaggagctatagtagatggattaactggtgtagatagtagacacaataaacaatggaagcttggatggaatagaaatagtattggatgttggtattctccagataacataaataaaacttattatacttcacaaaatggatggaagtgcattgatggagagtggtacatttttgatgaacagggttatgctcttgaaaattcatggtattatgatgaaagtgattgctgttggcattacctagatgaaaactgtagaatgatctatgcaagtgataataacccattgtggaaatggattaatggtggatgttatgcttttgatgaagaggggagaatgtatacaaactgtgtaacttcagatggatggagagttgatgagagtggtatgtggatagaatagattataaatgtaattaagatatctaaattcaccataaattcttcaaaaatgaatatatatgcaaaaaatttatatgttctctttacaaataaacgtatgttcgctaatatataaataagaacatatgtttgaggagtggcatatatgatttatgataatgacagaatagtatttcatgtagatgtgaattcagcatatctttcatggacagcagtaaagttattgcagtatggatctagtattgatataagggaaattccatctgtaattggaggagacattgaaaatagacatgggattattttagcagcttctatttccgcaaaggagctgggaataaaaacaggtgagcctattttttcagcaatgcagaaatgcagagaccttaaagtatatccaccggattatgactggtatgtgaaatccagcaatgcaatggttcaattacttgaggaatattcaccaaagattcagagatatagcattgatgaatgttttatggactgtactcattttaaggataattacaagaagatggcagttaaagttaaaatgaggataagtgatgaacttggttttaactgtaacataggaatttcaacaaataaactccttgcaaagatggcaagtgattttaagccaaagaatactgtacacactttatttaaagaagaaatatcacaaaagatgtggcctcttcctgctggtgatctatttatggttggaagggctacaaaagaaaagctctctaagcttaacattaacacaataggagatattgcaaaggcagatgtaaatcttcttgtgcagaaaatgcattctcatgggaagcttatttatgaatatgcaaatggaattgataattctgaaataagagaatgcaattatcttgatattaagggaataggtaattcaattacaatatcttatgatgtagaaacatatgaagaagcatgtagaatacttcttgcacttacagaaagtgcaacaatgaggttgagggaaaacagaagtctatgtagtctggttgttgtaagtgtaaagacaaataattttttatattattcacatcagaaacctcttgagaattctacagattcaacaaacataatatatgaagggatcaaaaaaacatttagagaagcctggaaaggtgaaaagataagacagctaggagtacgacttacaaaactttgtagtaatgaatattatcaagaaagtctttttgattttgaaaataatgaaaaacagatgaagcttgataaaactgttgatgaaataagaaaacggtttggaaaacaagcagtcataagatcaacattcctccattcaggcataaagccaattgaaggtggaacaggatctaatggtgattacccaatgatgagtagtatattataaggaagtgtgaaatatgaaagttgttgctaagagtatagaaatgattgcttatttcaaaagtgatggaatgataaatccaataaagtttaggatgcaggaagataatagttatgaagttataaaaataaataaaattataagtacagatattgagaaattatgtggtaataaaatgatggtttttacctgtagtgcttttataaataatactgaaaagatatttgagattaagtacgatgtagacaagtgcaaatggatgctttttaaaatttaaagatatttatgaagaatgattgtattatgaatttataatataatcatttttgttatataaaatttactatagagatattaaagggatcaagttaaaagacttttaataattgttgcaaaaactattatgtaaaaatgtccgtttttttgtcctgttatacacgacatacggttattataataaacatatctaagaaagaaaggaatgatcagatgatatgagttcaggaaactacataagagatagaagaaaagaaaaaggattaacacaggaagatcttgccgaattagctggttgcaatgtgagaacagtaagaagattggaaactgagggatgtgtcaaagaaactaatactattaaaaagatattagaaattttagaggttagaacgtctaggatagacaataaaggtcggcttgtattaaagttcgaagctgacgatgatgataatgaggagatacttaatgagttaggatgcaataatagcaatgaagtttttaatgcattaaaaaataatttgatacaggcatatcagcttgtagaaaagaaaaattattatgaagcactagaaatttatttagcagtttctaagctgtttgttaatgaaaaaatacatttaaaaattgcaattctttattataatatgggcagatatgaagaatgtattgatgcttcagataaactaataaatggtcaatcctatatatatgaagggttaaatataaaaggaatatgcctttccaagctaggaaaatatgaagaatctttagaaatattaaaagaagcgcttgaaattaaaggagattacattgattattataatctaggtgttacatatggaattaagggtgatacatataaagctataaagcagtataagaaatgccttgaaatcaatccgaatcatgcaagagctcatttaaatattagtatctgttattttactattttatctataaataaatcattatatcatgtagaggaagctataagattgaatccagacatgtatgaggcttatgctataaaaggagaatgttataggttccttgatgatttggattatgctgcagataattttaaattatgcttagataaagatccacaaaattattcatcaataattggaatgtgtattatttcagcagtaaagaatgaattaatagatggcactaggtattttaaggaactctttaaattatattcagataattttttcaaaacggataaagataaatcattaatagtggatataggatataagagaacaactgttatagaaattgagaaaatatctgaatatgtatataaagtgacattaggagatgaacatattgaaataaaagtagatagtgaaggcagctttatttatattggatgtttgccaatatcagatgaaacaggaaccatattatatcctacaataggaaaagcatatacagataaatatgaatatgataaatgtattgaaggaattgagagaacaatagaagtatttaaggcttcacagaagtatcctcttcatgtgaattttaagcgagaaatagaagttattctaactgaattagaagattgtgtaaagattgaaattatttttggatgtgcagataaatataaaattgtaagttatacagatactaaaggacagggattcgaaggatttatagaattttttaataaatataatcagttcagaattcaggtagagtacttagacaaagaagcattcataatagactgtataaaaaatgtaattataaacagaattaaaagtgaaaactgtacatactattaaatttatgcaaaagataatcagaaagtgagtagaatatatgaaacaaaactattgtaattatataaatgattttttgttaaatatggttaatgaaagaatggataatcttgaaaataatgatgaatataaagaaatagaaagaaacattgagatcctgaaaaatgaagtacgatatcatctggatgataaaatagatattaagcttaacgaattatttgaattaattaataagaagcaaataataagtgaagaatatttatataaagctggcttccatgatggaatagtatttttatctaatgttaactgcagataatatactgcttgttttacttgtaaaaaagagagagtatatatgttaaaatgcgtaagatagcgttgctatattaaataagattgtaattataaatgtgaagtgcacattataaaaaaatattgatgaagaagaggcatatgctgcataaggaggaatgagattaacagcatatgcttaaattatgcacaaaattagttcatttaaacttttccagcttaagataatgtatttaaggatgtaaatatggcaatgatatgcaaagcaggatttacataagttctttttagtgtagcatttttttagatgaaggcatattagttttcctttaatttagatgggatttattatagtatgccatattattatcaatactggggtttaaataattagttcagatttttatgccaaggtgctataatttcattatataatcacataaattagaatgtaattacctatatgaaaatatatgatattatatgaagtataaatataatacattaaacaaaatattttgaaaacatatgtggaaaggaaagataatggggttatttgattggttatttaaacgaaataataagaagaatatggagaaaaatataaagactgagtttggtgtacaaaatggtgataatgtagattcttcatatagaattttaagtagaggaaatgttgttacatataaaatagaattagataataatattaatcaacgattcatagcatttgatgtagaaacaacgggattaaatccttccagtgatagaataattgaacttggagcagtagtatttgaaaataaaaaaattattaataagtttagttctctagtaaatccacaaatcaaagtgccatctagagcaacagcagttaatcacattacaaataagatgctcaaaaatgctccagatgagaaagaagcctttagcagattaattgattttttaggagatgcaataaatggggcaacaatactttgtgctcataatgctccatttgatatgaaatttttatctgaaacattaatgaggttaggatatgatggaactatttattatgcagatactctttctatttcacgcaaattagtaaaaggattaaacaattataaacaggatacagttgcatcatatttcaatatagtaaatgaagaatcacatagagctgtcactgatgctgaagtatgtgggaaaatattaattcaattattagagattaaacaagaagagcaacagataataattggaaaatctcaaaatagtgtaccagattccgaagaaatggaagtatgtgcatatatacaggatgctatcataaaaaatggtggagattctaaactaatgagtttttataaaaatagtagcagatatattgatgtacgttatatgtgtaatatcgttaaatttaagtttgctaaaaagggaaaatatatcattgtaaaaaaggaagctgcagcaaacaataattataaaatatcagaatgtactatgagtgaaggtggatcagattatgttagatgtttttttaataatccatttgaactagaaccgttaattccatatatatataaattatataaagaagcaagaaattcggctttggattataatactaaatatgaaaatgagtatagaaacagtactgtaatgcagaatactttatcagaaaatgatgtggttatattattagagtcagcacaaaatcgtttaagtgatacaccaaaagaaaaaaatgagaagataattagtaatcaagaaaatgaaatacgaatagagagaaaagatatagaaattcatccagttaataaaagagtagctttatctgaaattaataatttgaataactgggacaaaggatttgatgaaggttattcgtattgggaagagggagataagctaagaaaagacggtagaattgaagaagcaatagaactatttgatatggcaaggtataaaggatatagtgcgccagttttatatcactcatatgcaatggcatatcataaaattaaagattttgaaaatgaaattgatattcttgatgaaggaataaaaagagcaaaaaaaggagattggagtgatggaaatctagagacaagaagaaataaagctatgctggcatttgttaagaatcaggaacagacaaaaaaatcaattgaaaagaaagaaaatataagtacagccaataaaactataaaaaagtctaacacacgagccattcttcaatttactgatgatatgatattaataaaaaaatatgaaagtatagcacaggcagtaagagaaacaggtgttaattcaaagagtatcagagatacagccaaaggcattcaaaaacatgcaggtggatttgtttggaaatactgcgattaggtcttactactaaagtaaattgaattctgctatagtcataaaagtatctattaatagtaaatgtttagataaactatcgtctctacaccagaatgtgttcttaacatttaaaatcacagtattatttaatgtgaaaaagccctcttgagatattataatagtaatattttttcttaatcacactttttaacgatgagctaaactatcagttaaatattgcgtcaaatgttgcaattactagggtaaggcttaaattttttgacgttatggaaaataacgtaaattcatgatatcattttgagattggaaagcatgtttttatgtaaaagatgaggaatagtgatttgacgatgcgtcaaaaattcgtcaaaaactaatgatatattataataaaaaatgcaacatggaatataataacaaaaccttgtaaggctgaattttacaaggttttgataggctttgttatagaatatagtaacgatttttcattttttggcgaaagcatgttttcaagagtaagcaacgcatcaaaaatagcactaataactcttgcagaagtgttaaaagaacagaaatttgaattcattgattgtcaggtatatactgaacaccttgaatccatgggagctaagatggttccgtttgatgaatttaaggctatgttacataggggtatttatgattagggttaaaatatatttggtattttaatccatgatattatccaattaaatggaaatgataagtgtgatatatgtcaaatagattctacaataggcagatttgaataattagcagtaataaaaggggatataatcatgaatgataaaaggatttattttaggattagaaatattattatatttactttgcttatgaacatgatatttatatttaatatcatgaagacgaaaattctatgctatataattggaataatagttttattattatatctatatataaacataattccattaagattaaaaaaattaaataaaagagtgtgcattatggtatcaggctatgagctcatagctgacagttctttggcagtacttatagaaataatactgtatatttttttattaaatacagataatctcacaataaattctaaagaatttataattaatggaattacagcagtttgcgttttgataattcctgttataaacggatttatgagaatgatgtttacatcaagaaatttaggagttgttaacaggcttttaattgttcttttatggtgggctccgattttaaatttcataattttaaatggatgctgtaaaaaagtaagatatgagtatttttatgaacagtcaaaggaattaagaaatgatgttagaaaagaaaatgaagtatgcagaaccagatatccaattgtaatggttcatggaatattcttcagggattggatgtttattaattactggggagaataccaaaggaactcatgagaaatggtgcacaaatattttatggaaaacagcagtcctcaaatgcagtatgtaaaagtgcacaggaattaaaagaaaacattttaaaaataataaatgatactgggtgtgaaaaagtaaatataattgcacattctaaaggtggacttgattcaagatatgcaataagctgtctcggactttcaaagtatgtagcatctttaactactgtaaatacaccacatagaggctgtaaatatgtagattttttattagataaagcacctgataaatttaagaattatgtggcgaaaaagtacaatagaacatttgtaaagcttggagataagaatcctgattttttagcaggagtagcagaccttacattagaaaaatgttcacaatttaacataaaggtaaaagatgtagaaggtgttttatatcaaagtgtgacttctaaaatgaaaaatatgttttcatcaggatttccactaaatattggctatatattagcaaagattttcgatggagagaatgacgggctggttgaagtttcttcagctaagtggggcaatttccttggcacactgactgcaggaaagaaaggaatttctcatggtgatatggttgacttaacaagacaggatataagagggtacgatgtgtgtgaattttatgtggatcttgtcagaaagcttaaggaaaaaggaaattaaatataaaatagcattttaaaattgggagtcttgaaaatatccatggaaattatgcgaccgactataaaatactatttgaatattaaacattataattgtataatgtaaataaattattttaggagggaaattatgaggacacttaatattaataatgaaaacaaaatacatcatcattactagagacttgatctgtaaaaaacagatacaagtctatcagcattaggcttgtatctctaggtaatgataaattaagtgaattcataatttatttacagccatgtgggatatctgcctacatggcttttttgcataagaaaatatataggagtgatttaaatgaagaagaatattataaaaccaagtatattaccaggatttatggagcttttacctaaggaacaagaaatatttgatgacatggtttctaagataaaaaatgtatatgaagataatggatgcttagcaatagatacgccaataatagaaaaagcagaagtattgcttgcaaagaccgggggagaaacagaaaaacaggtatataattttcaaaagggaaaaaatcagttagctttaagatttgatttaacagtaccatttgctagatatgtggctcaatattataacgacttagtatttccatttaaaagatatcaaataggaaaagtttatagaggtgaaagaaatcaaaaaggtagatatagagagttttatcaatgtgatattgatgttataggaaaagaaaaattgagcataggcaatgatgcatgggttataagtttagcatctaaagcttttaaatcaataggtttaatagattatagatttcaaataagtaatagaaagatcttaaaaggcatattgagtgaattaaaaatagataatgttaatgaggttatgatattaatagataaatatgacaaagtaggtaaagatgtattttctaaggagttagaaaatattataggtactgaaaagagcaattatattaataaagtattagacttaaatggtacgaataaagaaaaaatagaagaactttcaaagtttaatattgaaagtaaatattttattgaaggaatagaagaattaaaaaagatatgttatacattatcaatattaggtgtgaatgaggaagattttgaaattaatttaaagattataagaggtttagactattatactggaacagtttttgaaactatattagtgggaaatgaagggtatggttctatctgctctggtggaagatatgataatttagctgaaaattatactaataatatattgcctggagtaggtatttctattggattaactagactattctttgttttaaaagaaattggatttatagataaatatgaaatgaaaaataaattagattatttaataataccaataggtgatacaattgaatattgcatagaagtaatgaattatttacaatataatgggaaaaaggttacagtttattttgaagaaagttcgttaaagaaaaaaatgaattacgcaaataagttagatattaataatgtgatactaattggtgaagatgaagtagaaatgaaagaagtaaaaataaaaaatatgataacaggtgaaagtagaaatattgattatagacttttgtaaaagaaatatacttaatcagaaatccatttcttcttaatattaagtatgtatgttttgtggaaaataaatcctaataaagaaaaaatatggtataattacaagggagtttatattattctaaaatataaagatatatttatggagatgggaatatgaaggagaaaaacaattctaaaaattggggaataggaagtgtatctttaattctttctatattagcgactatgttttcttttactttctttaatggaaaatattttggggagcatattttaaagctaatgggtatatcattacctattaacgaaatatcgttagtcatgttagttatagcactgtttataggatataaatataaggagaattatttagctaaacaaggatttatattatcgttaattattatattattaatgtttattttaatattaacaagtaaattattttaatatagtagtttataggatgaactgttaacttgataaattaaaagaaaaaatgatttaataagtataacatattaattaaaatcgcagattcatattttgaatgatgcgattttttttgtctaaatattcacggtataatgtggaaatttttcacatgttaagagtgttaaaagaaaaatatggaattagttactttttgtgttataatactcactaataaatgtgttttgggaggttataatatgagaaaaaaagacagagaaattattgataaagaaaaaattgaacagataattgaatcatgtgattgctgtagaatcggattagttgataaagataaaccttatattataccattgaattttgcatatataaatgaaggtgacaagcaacttttctattttcatggaagtaagataggaaaaaaaatagatttaataaataaaaataagtatgcaggatttgaaatggatacaaatcatatgcttaaaaaaagtgaagaagcatgtaaatattcatttaagtatcaaagtataattgggacaggaattattactattgttacagatttaaatgaaaaataaatgggttaaatgggttacagttattaatgaaacattattcagataaagataataggagttttaatgagaaaatcatagaagagattgcagttataaaacttgaagtagaagagatcacgtgtaaagagaatcagtagtgattcttgtaatttattaataacttttatatgaaattaagggagtgtggtagatatgaaaactttagaaacagaaaggttgatacttagaaatttcaaagagtcagatttagatgatttatatgaatatgcaaaggttccaggagtgggggagaatgctggttggccacaccatgaagatatagagagtactaaaaaaattttaaaggattttattgaaaaggatgaagtatatgcactagttttaaaagaaaaaaataaggttataggatctttaggaattcataaaacaacaaaatttaaagaaaataaatctgatgtgaaaagagagattggatatgttttaagtaaagattactgaggaatggggttaatgcctgaggccgtaaaagcagcaattaaatatgcttttgaagaattaaacgttgatgtactattgtgtggacattttaattttaatcttaaatcaaaaagagttatagaaaagtgtggatttgaattttatgcagatggtgtttataagtccgaatctttaggaaagacttttgatgaaaaaatatataatataactaagcaaagatattttataaatgaataataactcttttatatgattataattatttttaaaattactgtaaatttgattaaaaatatcagttgatttgttggcgtagcattattaaaccaatccatagagattataatttaacttcaataatagtgagttattaaaaatataatctactatggattttttgtaagcaattagtaatgtaatttaattgcttattttaagtagaaataaattttaaatatactctaatattatattagagtatatgaatgaattatttagctacagaataattgtaattagctgaattattactatcccaagtgtttgaattattcttgaaacacatattaagtagatagctttcagatggtacagtaatagttgcggaccatgttccatcagaattttttgtcattggagtatctgtagttgttgcccaagaattatttccccaatgtaatgtaattgaagatgaacttgaagctaaagtaccattataagtaacagtaacagattttccagcagtaggcgctggagaaagtttaactggtacagtgcttgaccatactggtaaagtccagtttttactactattattatcccagttactaccgtctgtaaaagtaaaattcaatgtagtagcagaagttggaattgctatagttcccttccagaatccattagaatctttagtcataggaatatctgttgtacctgtccaagaattatatccccagtgtaaagaaacagaactagaatttgttaaagaaccattataataaatagtaagattttttccttgtaataattggctgctatcataatctactttataaccagaagtaggtgcatagccagtagtattagatgaatcatttgaatttgcttttacaggaatagtccaatttgctgaattattattatcccaagttgttccatctgtaaaagaaaaatctaaatcttttgtagcagtacttggaactgttaaagttgtagtccaagtgttatttcctaaagaagtcatagtagtatttgttggattagtccaactgtcatatccccagtgaacttttacagtagaagaattctgtaagcttctaccagaagcgttataagttatttttatagagttacctgcaactgcagtagaaggatcacatgagacagtagttgtactattattattattgttattatcatttgtacttgtaccataaagtacaacaatagaatttgcaggaatagttcctgaaattgttccatttgaaactgttaatgtacagtttgcacttccatgattagtataagttccatttgctagatttgtagaactatttattgaagtgttagaaccagaatttacaattacagtaccaatagttccacgatctattaacatagtttgattattatttgtatatcttatatattcattttgaccagccattgcattgtggaatttatttacagcaactacatcaggatctttccataatgaatcaccttcatttccaatactgcttgttggtctattaaagaataatggaacagcattagctcttgatgcagccatagcccaacctaattttctttgtgtatcagatagtcctttgcttgtaccatcttgataagtatcatgagtttcaacaaaatctactgctttattggaatcgataccggaaaaaccattgccaattgaacttaaatttgaagatgtaacggcatttcttaaagaatatccaaaattactagctgtaacattcatgaaattttcatatgatgagatgttgtctactgtaccatcttgaagaatttctccatatataaataagtttgatttattatgaagattacctaaaacattagtccaatagtttccagcccaagattgattagaatctaagccagtattagtttcaatatgttttgcagcatcgaaacggaatccatcagcaccagcatcaacacattgatttaaaaaagttatagctttgttttgtacagcagtattttgagtattcaaatcaggcattccaatacctttttgtgtaatatcatatctagcattccaattgctacattgtccaagattatgatagaaactagaatctttaaatgaagaatcaactgaggcatctaattgatctgaattaccattattagccatatgattcattactacatctactattattgaaattccatacttatcagcttcagtacatagtgatttaaaatcatcataagttcctagttgactattaccaattgcttgattagtaggttgatataacaaccaccatttgcttgcatccttgctggaatccttagttccttgtactggagaaacttgaattgatttgtatccagaagaagctatatttggtaattgatttttaatagtattaaaagaccaatcgaatgcatgtagtattactccatcttttgtgttagatggtagtgtagtagaatcagcagcgtaagctatttgtccagtatatttactaaataaatttaatttatcagaaggtaaaagtgcaatattaaatacaaggataaatgttatcaattttgaaataaattttttcttcataattgttgatactcctttttcataaaataataaaaattacacttatatattgagggcccattcaatgtataaatttatctatagaaatttttataaacataaaatgtttataaaaataataataacatgtttaagaaaaaaaacaatattttacaaaaaataaaaggatatttaagggttaatttgttatttttgtaaatacacacaaaatgtgaggagaatttaactaaataaataattttaagttaaaaataagtaaaatggtatggtatttgctatatattataaatataggatattcatttcaataaatgatagaaattacaatatgatatgatggcaacttcaaataatagattgattttaaaacaagaaaaaagcaagaaatattattgataatattcattataaattatgatataatcacaaaaaaggaaggaggaggaattcaagtggctaaattatccatattaaatgaacgtatggaaaagtatgcttgtgaaaatgtttcacaaatatatgaagattttaacataaaaaagcaaggattatctgattcagatgttgaaaacatgaaatatagatatgggaaaaatatcatagctgtaaaaaaagaagatacatttttatttagattaagacgatcatttataaacccatttactactatactgtttattttaggaattatatcattttttacagatacagttctttatagtgtaaaacaaacacattcaataactacggcaccaattatagggattatgatcttaataagtgggtgcttacgttttttacaagaggtaaggtcaaaaaatgcagctagtaaattgatgaaattagtaaattctcatgttactgttttacgtgatggaaaatttatggaaatttctgctgacaaattagttgttggtgattatattaaagtgtctgcaggggatagaattccagcagatatgcgttttgtttttacatctgacttatttatttcacaggcagttataacaggtgagagttcagtccttgagaaaactcataataatttgaaaaagggaaagtcatactcattaattgattatgaaaaccttggtttcatgggaactacagttataagtggaaaaggagaaggaattgttttagctgttgggaaagaaacattatatggaaattttaatatttataattcagaacgtaaaagtagatttgaaatatcatcaacatctattgcttcagtattaattaaatttatgattatattagttccgttaatatttattcttattggatttactaaaggagactggataaaatcatttttatttgctttatcagttgcaattggacttacacctgaaatgcttccaatggtaattacaacctgtcttgcaaagggatctatctctatgtctaaaaaggagacgattgttaaaaacataaatgctatgcaggtatttggaagcatggatgttttatgtatagataagactggaactttaacaaacaacgaaattgttttggaatactttatggatattataggaaatgaagattctcaagctcttgattatgcatatttgaacagtttttatcatactggtgcgcagaatcccgttgatgatgcaatcttgaaatgcagaaatatgccaaatcatgaacaacattttctgagtatttcagaagaatggagcaaaagagatgaacttccatttgattataaccgtaaatgtgtgagtatattggtagaagataataatgaaaataaacttatggtaattaaaggtgatataaatgaaattgctgataaatgtagttttgtacgttttaatggggaaaatattaaaatacaagatgataaaagaaagaatataaatgcagttgttgatgatatattagaagatggaataaaggttattgctgttgctataaaaaatattcaacgtgataaaaataatataactgtagaagatgaaaaagatttgattttaattggatatcttgctttttttgacgttcctaaaaaatctgcaaaggaagcattaagaaaattacaaaatctttctgttgatacaaaaattctaactggagataataaaaaagtaacagcatctgtatgtgaaaggttaggcattaatacagaaagaattattttaggaaaagaattagagtcattatctgaagaaaagctaaatgaaattgttgagaaaaataatgtttttgctgaattgactccacatcagaaagtagaaattattttgacattacgtgacaatggacacattgttgggtttatgggtgatggagttaacgatgttcctgctttaagtgaagcagatgttggtatttctgtagatagtgctgtagatgctgctaaagatattgcagatgtgatactgttaaaaaaggatttaaatgttttagaaagtggtattttagagggaagaaagacattttcaaatatgacaaaatacatacatatatcagcaagttcgaattttggaaatattttctctattgtatgtgcatgtatttttcttccatttcttcctatggcatcgttacagcttatacttttaaatttattttatgacattatatgtattatactgccatgggataatgtagatgaagaattatataagaagcctaatgaatggtcaggaaagcatttgtctagatttatgctattttttggttctataagttctatatttgatattttaacttttatatttttatattttataatgtgtccagcattatgcgatggaaagttatttcatatgataagtgatgtatcattacaaatcaaatatatgatgatatttcaaagtggatggtttatagaatctatgtggacacaggtgcttataattcatatgcttagaactaaaaaagtgccttttattcaaagcactccttcaattccagttatggttgttacaatagttggaataatatgctttactggattttcttatttaccagtagcaaatttattaggtttaacagcattacctttggtattttactgttatttaatatttattgtagtttcgtatatgcttataacaacattagcaaaatctttttatattaaaaaatataaaaaactattctaagaaggaggaaatatatgtgaaaaagaatgcaagctttataacaatagattcttcttcaataaaatggttgattgaaaagatgagtcaggttcccaatgatagcctacatagtttaaaggaattaaaggatgagctatcagagttattacagggagaaataagtagtttaatattaaatacagatgagttagatgaagattatactgtatcagcaaatgttttgaaatttaatgaattagaaataaatgcgaaaaataggacggtacaggaaagtggtcgggcaattgtacttactccaaaagaatttgaaatattatattttttggctcaaaatcaaggaacggtgtttacaaaagaacaaatatataatgcggtatgggatgaagattattttttatctgatagcaacattatggcatttataaggaaattaagaaaaaaatagagccaaatccagacgaacctatttatattattacaatttggggagttggatataagtttaatgataatttataagaaaagaatagtattaattatagaaagcaggattttatcataaaaagatgatataatcctgctttctacatttcttgctaaaatgcaaggaaatcgcaagattttagccatgggtttaaaagatactttttaatatactaaaaactgtagtactactaaaacaaacataagaaatggagggagaataatgttcaagaataaaaaaatgaaaataacacaagatctaaaagaaagcatggtaaaaaaggataatgttaaaaaacgtctaattatctctgctatgcaagaagaaaatttagtactagcacacatggaaagtagtaaaaatggattatccagtgaacagattgaagaaaatcgtaatttgtatggaagtaataaaataacaaagcataagaaagaatcattaataaaaagatttgtggaagcttttataaatccatttacatgtatattgatctttttagcaatcatttcagcatatatggatatcattcttgcagaaccaggtgaaaaaaatccaactacagttattataattacagctatgatttttataagtggaatgttaagatttgtgcaagaaacacgttctggaaatgctgcagaaagcttgttaaagttaataaagacaacatgcactgttaagagagatggtcatcaaatggaaattccacttgatgatgctgtagttggggatattgtatatttatcagcaggggatatggtaccagctgatataagaattcttaatgcaaaagatttgtttataagccagtcttcattaactggtgaaagtgaacctgtagaaaaaagttcacaaaaaattataaaagaagagtcaatttctaattgtaactgtcttgcttttatggggagtaacgttataagcggttctgctacaggaattatagtagctgttggagatgatactctatttggaacaatggcaaaagatattcaagaaaaaccgactgttactagttttcaaaaaggtgtaaatgctgtatcatgggtactaatacgctttatgtttataatggttccaatagtattttttataaatggaattacaaaaggggattgggttaatgcttttacctttgcagtatctgttgctgtaggattaacgcctgaaatgctacctatgatagttactacatgccttgcaaagggtgctgtagcaatgtctaaggaaaagacaattgttaaaaacttaaattcaatacaaaattttggagcaattgatattttgtgtactgataaaacaggtacacttacacaagataaagtaattttagaatatcatatggatgtagatggaaacgaagattgcagagtattaagacatgcttttttgaatagttattttcaaacaggattaaagaaccttatggatattgctgtaattaatcgtgtaaaagaagaaagtgatgagaattattctttaagagaaatagaaaagcaatatcaaaaggtagatgaaattccatttgattttagtcgtagaagaatgagtgttgttgtttctgatgattcaggaaaaagacaaatgattacaaaaggagcagtagaagaaatgttatctatttgctcttatgtagaacgtaatggacaagtgattaatcttacagatgacatgaaaaaaactgtacttaaaacagttgataatttaaatgatgatggtatgcgtgtaattgctgtagctcaaaagactaatccttcacctgttggtgcattttctgtaaaagatgaaaatgatatggtgttaattggatatttagcatttcttgatccaccaaaagaatctacagaaatagctataaaggcattagctgaatatggtgttggtgtcaagattttaactggtgataatgaacgtgtaacacgatgcatatgtaaaatggttggattaaaggtagattatattttaacaggttctgatgttgataacatggaagaagacgtattatcagaagtaattgagacaacaactgtatttgctaaactttccccatcacaaaaggctaagattgtttctttattaagaaaaaatggacataccgttggatttatgggagatggaattaatgatgcagcagcaatgaaggcatctgatgttggaatttcagtagatacagctgttgatattgctaaagaaagtgcagatgtaattcttcttgaaaaagatttgatggtattagaaaaaggaattattgaaggtagaaaaacctatgcaaatatgattaaatatataaaaatgacagctagctctaattttgggaatatgttttcagtgttagtagcaagtgcatttattccatatacaccaatggcgagtatacaattaattttgcttaatttaatttatgatatttcatgtacagctattccatgggataatgtagataaagagttcattgaaaagccaaagaagtgggatgcttctagtattggtaaatttatgatttggataggccctactagttccatatttgatattacaacttatcttttatcctacttctttatatgtccaatgtttgtaccaggggcagatgggagaacatttaattctattccagtttcagaagtggcagtaagaagtacttatataatgatggctcaggctatttggtttgtagaatctatgtggactcagacacttgttgttcatatgatacgaacaaaaaaagtaccatttttacaaagtagagcctcttttccagtaatatcattgacatttacaggaatagcagtacttactgttataccatttacatcctttggaagaatgattggtttgtacccatttccaagtgtatttttcttttggctagcagtaactataattctttatatgcttattacaactgttatgaaaaaaatctatataaagcgatatggtgaattattataaaaggataaatataaagttgaatttattatagataaatttgcttataaattataatgaatgagtggggatgaataatatgacagaaatagaaatgtggaatgaatataataaaataaatatgaatgccaaaaattatgaggcttggtcatttggaggaaatacacctgaaatgcctgattttttagcagatttagtattgaagggaattaaaacagcaacagctagtgcatatccttgttatctttatgaaaatgctccattaccaccattaggtggatataatattatattaaataccaaaggagaagctgtttgtattacagaaacattaaaggtatatacaataccatttaatcaagtaagtgaagaacacgcgtacaaagaaggtgagtttgaacgaacactggaatcttggagaaaaattcactctgaaatttttacaaaggaattaaaatatattggaaaagaatttacagaaaatatgatggtagtttgtgaagaatttaaagttgtatatccaataaaagaatcttagaattaaaaaaataagatcatatttataacaaattaatttaaaagttatgctattatattaatttgttataaatattattatacaaatcattcattttttagagtatcattaaatactaaaacaccactttttccatttcttttaactttatacatggctaaatcagctttttttattaaattttgcttatcaaagtcattttcatcagaaaatgcaatgccgatacttactgatatagaaataggcttaccaatagctgttttaatattgcttatttcttcaaatattttttgagctaaacattcaaccatatctggtttatcaaaatgtgatataaaaatcagaaattcatctccaccaagtcgagcttgataaatatgcttatcctgaaaactttttaagatattagcaactgatactagaacggcatctccaaaatcatgaccataactatcattaacatttttaaatccatctaaatctaaaagcattgtagcctgattggtgcaattaatattttcatccataatatcataaattgcagtacgatttggaagacctgtcagtatatcagttttagcggattcttctaattttttatagctaatatctaatttattggacattacattaatggctttgtaaacttgagcaaactcatcattaccttcatatgtataattacaatataaatttccatttgcaacagcatcaatattatctataagtgattctaagggatttgtgatgccttttacaaataacagactaagaactagggaaacaatccctgttattgtagctgctaatataatgatattatttataaaaaaactgctgtgattaatttctgaatgtggaattgctactacgacaatccaagaacatccagaaattagatgatatgatgctagagttttagtatcttctaaattgtattgaaagaaataacttttataagatagagcatccttctttatatttttaaaaattttttttgattgttcgctttctaaaaaaggtgtgatatttatgttgctattgcaagatagaacattataattttgatctaatatataaatatatccatttgaacctattttggagctgttcacgtgtttatcaatttcatcaatacttattaaacgaaagatggatcctataactgaaccatcatcatctataactggatatgcaattaaaatttcttttttatcattttcatcaataatttgaaaagtatccatacgcttttcttttgcatctttatatgcttttgaatgttctaatgaaatacctaattttgttttatcagggcatgctactatttttccattaacgtctgtaagaaaaatattatttattctattatctgttgaaattgcggtttgctgtaattttattatatcattaaataagcttgaatttagagctgaatcagtaccatttaatgaatgtaaatattttttataaactgaaaggtttgaagaataaataagtgcattcttttgtgtattataaaaatctgatatatattttgcagaagattctgcttgattagaaattatcatttgataatttttcattgcagaagttgtgttaacttccattataataaatgaaagtaataaaattggaagcacagaaagaattgctacaaacagaggtagttttgtttttatttttaaattaggagctatcataattcacctcaaaaattttaagtatatttataatcagaatattaaaataatatatcaaattacaagcatgaattgctttttttgtttaatatttgtattatatataaagtttaacataagtcgacagcattttaaatatgatgacagaatgggtggattaaagaaaacgatattattattttaggtaaaataataatagctttaattgattgaagtaataacaaaacttacatattaaaatttgagaaattataaaattacacactaaatttatgacttattttcaaaaatggtttttatgtagattatttttattaagacagatataataaaaataatctatactaaaaaatttaataatcaataacataggaacaaaacagataaaaattaaaattttaataataaatatgataaggtgtgttaaacatggaagaattaaaaaacgcaatagaagaaatttctaaagagaaaataataaaagtagtaataagtaataagattaataaggaaacaaaatataataaaatagtatttttattaaaggaaagcaaaaataaagagtattatcagattgaaaaatatacagataagcaggtttttcatgaaaatatagatttggatttatttaaatctaaatttgaagagagcatagcaattggatataagcaggtttcagcttggtctgatagtgttacatatgatcttagaatttctaaaaagggaaaggttcatcttggaaagaaaatggatgacaatgataacatagcaaaaaaaagccacaataagaaaaagaattatatattacaagaaggtatgataatagaaccattaatagaccttggagtatttactaaagagggaaaggtaatcaattcaaagtacgataaatataagcagataaacagatttgtagaaattatagacgatgaaataaagaaaaatgattataaggaacttactattttagattttggatgtggaaaatcgtatcttacatttgtgctttattactattttgttaaaataaaaaagattaatgttaagatgataggtcttgatttaaaggaagatgtaattaaaaagtgtaatgaaattgcaaaagcttataaatatgataatttacattttgaacttggagatataaatggatttaaatataataataaagttgatatggtaataacacttcatgcatgtgatactgcaactgattatgctttatataatgcagttaaatggaatgcaaagatgattttttcagttccatgttgccagcatgaatttaatagtatgatgaaaagtgattcattatctatattaaccaaatatggtattgtgcaggagagggttgcagcacttatgactgatgcagttcgtgctaatatacttgaagcatgtggatatagaacacaacttcttgaatttatagatattgcacattcacctaaaaatatattaataagagcatcaaaaggaaatattacaaaagaaaagaaagaaaaatctttactggaagtgaataatctggtaaacgagtttaattttaaacctacattattaaaactggtgaaaaatgataatttagtgtaaaataaaagtatagaaaacaataaattggtgtagtttgatgaaatttatttaatattaacttaataaggaatattaaataaaataaatttaaaaagtaaggggaagagatcatgaataataatatattattagaatcaggaacaggtgaattagaagtaattgaatttatggcaaataattgtcgttacgctataaacgttgttaaggttaaggaaataatagaaatgcctaaagaaacactgacaacattaccagatccaaagccagaagtggctgggcttatattatgtagagatgaaattcttacattaatagatttaaaatatattctgtgtaagagaaattcaggaaatcttgggtcaaaggttataatctgtgagtttaataaggttaaggtagcatttaatattgatgatatagttggagtacatcgtataaaatggggagacataagaaaacctgatgatttatctgaaaattcattatctgtaggtaacatattattaaatgataaggtaataataatgcttgattttgaaaagatagtaacagacattgctccgggagctggaataagtgaagatagacttgttaaagttgattatagggacaggtctgatattaagctagtacttgctgatgattcagcattgataagaagacttcttaaagaaaccctttctaaagcaggattcaagagcatgacagtttttaatgatggaaagcaggcttttgattatatcgtaggacttaaggacagaagaggagaagaatttttagaggatgtagatattcttattacagatattgaaatgccacagcttgatggtttaacattaacaagaaaaataaaagaagatgaggttatgaagaaacttccagttattatattctcatcattaataacagaagaattaagacacaagggtgaatcagttaaagcaaatgctcaacttagtaagccagaaattgaagcacttgttgatgttatagataaattaatagaaaataataaaatttcttagtataagaggttattgaataattatataataataaaaaagattgaaagttaatattttgagctttcaatctttttttatttaagctattcttgagatacatttttcaataccttttgcaagagttcaaaaagtatttcagattcacctttagtcattccttttgtaaaatatgtttcaaatattaaggctttttcaaccatcttttcataaatatcttttcctttatcagttaaaacaatttttttatagcgtccatctttttcactggcggtacgatataaaaaaccgttattttccaatctgttaagtatatctgtaacagtagaattttttaaataaagatttttttctatatctttttgattaatttcaatgtcgtcattagtagatatataaaacaagatgttcatttgtgatgaagtaagattcatttcttttaaacccttatcactgatttttttaaatacattacgaatagtaccaaagagcatggaaaattttaaatcagagttcatgagtacatctcctattcatttaacattaagtataagtgtattttaccgtacttgaatacatttatgcaagatattagtcctatagtaccctctaataaagagacttttgatttaatagtgagcactaaattttaatatatatttattttataagtatataaattcatttattgaaaatattcataaagataatgttaaaacttaaaaaatatattttattccatactataaagtaaatattgacattataaaaaaaagaatttataattgtttattagttccagtacatagagtacgaactatatttaattataaaaaagtaaaaaacattagttttatccctttaataatgataaatataactaaatgtttaaacgaataataaataaatacatagtgtactaactagtttgggtgcatatattgctgattgcaacgttttacaaatatgtttaaagaaaaaagttatactataaattcacgtttatacgtacaaggaggattattatgaaatttaagaaagtatcattactgcttttagcagttataacagcaaatagttttatggcatgtagtttaccttttgctcatgtaacaggtgatcaaatagtagctggtaattcgaataatttggtaattcagtctaatataaaaatggatgaaagcaatgttaattctttaacaggaggacagatttcagaagttttagtaagtgaaggtgatactgtaacaaagggacaagcattagttgcattagattgcgattcactattggctcaaaaagcgcaggctgaagcaggtgttgaacaagcaaaggcaggaaaatcacaagctgaggcagcaaaggcacaagctgaagcagcacttcaaaaagcaaaaaatggtgcaactcaagaggaattaaatcagctgaaatcggcaattgatattgctaattctaatgtggaaagtgcacagtctgcttatgatgttgcgaaaacaaactatgatagaacaaaaacattgtatgattctggagctgcaagtcaagcagagcttgaaggaaaagaagtaagtcttcaaagtgctcagacagctttggataatgcaaaatcaaatgttcaaattaatcaagaaaaatataatcaaacaataaaaggagcaacagcagaagatattgcccaagcccaagcagcagttgatcaagcacaagctggtattgataaagcaaatggagcagttgaacaagcagaagcatcagtaaaacagcttgaaattactttagaaaaatgctctttagtatcaccagttgatggagttgttacaacattaaatgtaaaagatggagatttagtatcatcgggaatgccagcagtagtagttaccgctataaataatccatcaataacttgcaatataaaagaaactgatcttgataaagtagatttagaccaagaagtaaaaataaaacttcctgcatatgagggacaggagtttaaaggaagggtaactaatattaataaaaatgctgattttgctacaaaaaaagcaactaatgacaatggagattttgatattttatcatatggagtaaaagttgaatttgatgatttagaagaacttaaaaatatgggaataaatcttcgtgctaacatgacaacatttgttgattttggaaagtagtgtgattatatatgaaatcaaaaataatatacggaattgataaaatagttgctataaaagattcggtgaacaaaaaagcagaaaatttaaaagaagaaattagaaaaacttcaatatataataacaaactaggtcaatttttcagaaaactatacaattttatatatgaacaccttttaaaacataaatatatgataataccaatagtaatcttactagtattaccaccgggccttagcattttactaggacttgaattttgtaaaaatcctgttgacaatgtgcctacaataatagttaatcatgacaattcatctacaatacaaagtcttattcagatgatagaagataatgatgtttttgatgttgttgttcatagtaatgatgatgatgatataaaaaagtatattgataatggaactgcaatggcaggtcttattattcctgaagatttttctgataacttattaaatggaaaagaagcaacgatactatcatttgttgatggaagtgtaacatcgccatctagtgctgcaaaaggttctatatctgaaacattgggaacacttaaaagtgggtatctaatgaaactcgcagagggaaagcttggaatgacaccacaaaatgctcagaatttaatttcacctatgggatataattatagatttttaggaaatccaactaagaatatgtccatatttatgatggagggaattatattgaacagtatgcagatagcagttgctattgcaggttcatttatcagtgaaaagaaaaattatattaaactcataggaaaaggcgttataattggtttattaggtgcattatcatcattaatttgtatgtatacacaaattaaattttttaatattccttatagaggaactgttttaggtggtgtactattgactattttgtgcaatttaggatgggctttttttggaataatccttaattatagtaaaaagggtaatagattagaagctgcttcttcatgtggtattgtctcaatgactatgttattttcaggatacacatttccagtacttgcaatgccagaattcttttcgaagattgtgaattttatgccaaatactcactttataattccattaagagatatatctttacttggctttacatatgatgatgtttcagtacatgtaatttggcttttaaaatttgcattgttaatggttgctttggtaacattacaatttgtactaagcaaaattcctaaaagggaaaaaagttcaaaagcaaaaggaaatgttaatgatgaaaaagaagtccttgaagacatacatggaatagattcaaataatggacaacttgtaaaagtcaataataaaggaggggtacaatgatgaactattttaaattaggagtgaaaaaatttttatccattttaaaagaagaatcaagccgtctaataggagtaattgtatcacctttaattacattgtttctgttatcttatgtttggagtaatgtatacgtagaaaatattccttttggtatagttgacttagataatacttctttgtcacgaacagtaattgagcagttatcaaattgcccatcgcttaaggtagatcatttttttgattcagaatctgacctagaacaagctgttaaagcgagaactgttcatggaggtataataataccacaaaattttagtaaagatgttagtatgaaaaaatcccctaaagcggagataatagtcgatggaactaacatgcttattggaggaaatgcattaagcggtgcagcatctgtaatgggaactttaagtgctggaacagagcttaaaatgcttcaaggaaatggaatgtttccatcggtagctaaaacggctattggaacattttcatatgtacagcgtatattatacgatcctcagggaagttatattaggaacatgtcatataccgttgttcctcttgtaattcaaatggcctttttatgtgaatttttcatacccatgttcataaagaagaaaaaagattttgcaacaatgaaaatacgttcaaaagaatttatatttagtcttttagatataattataaggatagcattatttgctttagtagtaattatagcaacatttattggattatgtttaataaaaaggttctattctctgccaatgagaggggaactttggatatatgcagtgttaatgatagcatttttctttaatctcattggatttggacttgtgtttgcgtccatattaagtaaaatggattattttgtttttgtatataccgtatgctcaaccccttttatgatgacatgtggtgtggcatatccgttttatatgatgccagctggtgttgaattctttattaagtttatatcaccacttgcacaagtagcagtacctttaaagaatcttaatttgaaaggtgttggatgggatataatacttccgtactttaaagaaagtattggatattcgctattttggatacctataggattgattatgtatattataagtgtaattattacaaaatacaaaattacaaagtcttcacaatatatagattctgaagataacatgaatattcaaacaattcaatagtatatagaataaaaaatttatagaattgctttcattaataatttataattggaattaatgaaagcaattctttttggtataaaattacatgaaacaataattaaaaatttagtattatttttaatatttatgagaaaatattaaaaaagtatgtattttgagttataatataaagaaatacagtatttacattaatacgttcattttaggaaggcaggtataaattatgtataaaaaacaaattgaagagtactttgaaaaaaataaagaacaaatacttaatgatatatgtgatcaaataagaataaaaagtgacaggggtgaagcaaaagaaaatatgccttatggtgaaggtccagctaaggcccttgaagctgctttaaagttagcagaaagcatgggatttaaaactaaaaattatgataattatgttggaactgttgattttagtgataaggaaaaaggacttgatatactagcacatttagatgttgtcccagctggagatgaatggacagtaactcagccttatgaaccagtaattaaagatggaaagatatatggaagaggaagttcagatgataaaggtccagctatagttgcgttgtatgcattaaaagctgttaaggatatgaatattccattaagtaaaaatgtaagattaatattaggtacagatgaagaatgtggaagttctgatattgaacattactatgcagtagaaaaagaagctccaatgacattttcacctgatgctgaattcccattaataaacatagaaaaaggacgtttagcagcagaatttacaagtgaatatactgaagataaggcactcccaagagttataagagtaaatggtggagtaaaggctaatgttgttccagataaggcttctgcagaagttgaaggttttactttagatgttgtttcagacttatgcaagaaagcagaagaaaaaactggtgttagatttagtgttacagaagatggttctgtaataacaataaatgcaaaaggtaaaggagcacatgcttcaacacctgaaaatggagacaatgcgattacagcaataattgaattattaacttcaatgccatgtgctaagagtgaaggatttgaaagattatgtgctgttaataaattattcccacataatgaccatattggtgcaggatgtggagttaatatgagtgacgaattaagtggaagcttaagtatggcatttactatttttgaatataatactacatctttaaagggaacttttgattcaagatcaccaatatgtgcaaatgatgaaaatttaactgaagctttaagaaagaatatggcagatgttaagattgtattaggaactgaagaatctgataagttaaatccagcacatcatgtaaatagtgattctgagtttgtacgtactttattaaaatgttatgaagattatagcggacaaaagggtgaatgtcttgcaattggtggaggaacttatgtacatcatttagaaaatggagtagcatttggatgttcaatgccaggtactgataataacatgcatggaaatgatgaatttgctgttattgacgaattaatgcttagtggaaagatatttacacaagcaataattgatttatgcaaataaaataaggtgactaaaacaaggtgactgtcacctgtcgaattaaacgtaaaaagcagttgtataatgttaataattttatttatataaaacatataattggctttaacttaaaagtctagtaaatttgaactttttaaatttactaggcttttattaatttaaaaagaatttttaaggattactttcaagatataaattttaataatgcgtgcttggcagatattatagttaataaaaattaaaaaataaaaaagttttatataatgtgcaacattttatagttgctgattgtgttaatagtataagagttatttaagactaaaaatattaaaattacaatttatgttttgaagagaatattaaaagagttaatgaaaattttttagtttctatgcaacattttaaatcttaaacttgtatcaataatatagaaggttttaagaaataagaaacttaaaataagaataaagaaaattttattaaattagttatttaacttcaaggaggaatttattatgataagaaaaaatttgtttagaggaataccattttgtttagctttaggtttaatgattacaccagttatatctgctcatgcagaagcgtatggaactggattaacaaaatcagctataaaagatgaaatagatccaggtttcatgattaagcctgaaatatttgttaataataaggaattgaattcagatgatgttaaaatattaaatagtgaagcatatcttccattagaaaaagttgcttttagcatgggagatagactagaaggctcatatgaagatgcatacatgcttagaaaaagtgataaaatgataaatatggacataaaaaacaataaatacagagtaaatggtatagaaagtaatgtgaaatttgaagttgtagataatacagtatatgtaccgattagatttttaagcgatgttttaggatataatatgggatacgaaggaaactgtatttatataggtgaaggatcagaacaatataatgaaaatgctaatggagaagtaaatgttgatttgtcaggagatcatttaatagatgatgctatgatgcttaatccagaaatatatattaactctgataaatatccagactttggtgtaaaagtatatgatggaaaagtgtatttgccaatagaaactgtaactttaaaaatgggagatagacttgaaggtgatatatcaactgagtattatttaagaaaaaataatatgatgcttgtaataaattttgcagaaaatacttatatattaaatggtaaaaaacatgaaagtaaaatgataactttaggtggacaagtttatgcatcgttagatttctataaggacgtattaaattattcaattaaagaagatggaaattcattttatataggtgaaattaaagataaagaagttttacctaatactgtatcaggggggaaatggttttttgaaaatggaaactggtattattcaaatggtgaaagtagaattactggatgggttagagataataataactggtactatttaaaagctgatggatcaatggctactggatgggttaaggatgctggaaagtggtatttattaaataataatggtgcaatggaaacaggttgggttgtagataataacaatgcatattatttaaataaagatggttctatggcaagtggaactactgttgatggatttatgttagctgatagtggtgtggcaatatcactttactaaaataaataaaaaaatatattatagtgtttatataagctgtatgtacgaaatgtgattttatatgtttcatacatacagctttaatttctataatagtttatttattaaagagagatatttgagcaataaattactatagaaagtaattaaaaatatgtagcttttattatttttataaaagttttatagtttaagatatatatggattatttatgtgttttaaataaaaatatgaaatatatgcataaaaatgttatttatttttattgacaacatgctactagtgaagtatactgatattaaattaaatattggatttgttaaaggggagtagtcaaaaatatagcatcaacagccgcggcgtgtttagcctggtgttatatacctaaatggtgatgagacttttaatataactttaaaagatattgaagttatattaaaggtctcttttttattattaaaattaggacttgtaaaataatttattactaaatattagagaggaagattattatgaacaacttttttagtaagaccacagatgaatgtttaaaagaattgaattcatctatgaagggtctgtcgaaagaaaaatgtactgatcttttgaattcagtgggagaaaatattttaaatgaaaaggagaagaaaagtatatggtctgtatttattgagcaatttaaagattttttggttattatactaatagcagcagctattatttcagcattgactggaaacttggaaagtacaattgttattatagcagtaattttaataaatgcagtattaggtacagttcaatatgttaaagcagagcaatcacttgatagtttaaaagcattgtcgtctcctaatgcaaaagtcataagagatgataaaaaggtagaaatagcatccaaggatgttgtacctggagatattcttcttcttgaggcaggagatttagttgttgcagatggaagaattttagaaaattattcacttaaagttaatgaaagttctttaacaggagaatctgaagcagttgaaaaaactcaagatattataaataaaactgaagtagctcttggagatcaaaaaaacatggtattttcaagttcgttagttacatatggaagagctactgttttagttactaaaacagggatgaatacagagcttggaaagatagcttctttaatggaagaaactcaagaaaaagctacacctcttcaagtatctttagatgaattttcaaaaaaattggcaattggaattataggtatatgtgctttagtatttttcttaagtatgtatagaggaactccacttttagactcattaatgtttgctgtagctttagcagtagctgctataccagaagcattaagttcaatagttacaattgttctagcaataggaactcaatcaatggcaaaagaaaatgcaattattaagaagcttaaagccgttgaaggtcttggatgtgtatctgtaatatgttcagataaaacaggaacattaactcaaaataaaatgactgtaaaaaagatttttgttgataataagacaattgatagtgaagatattaatataaatgatgagttagaaagctttttattaaatagttctattctttgtagtgatgctgtttcagtagatggcaatgaaattggtgatccaactgaagtagctttaacaaacttaggacataaattctcaattaatgaaatagaatgtagaaaaacttatccacgacttagagaaattccatttgattctgatagaaaattaatgagtactcttcatcatatagatggaaaatacctaatgataactaagggtgctctagatgtacttttggaaagaacagtaaatataaagacttcatctggtataagaaaatttacaaaggaagatgcagataatataaatgctgctaacaaaaatttatctacacaaggacttagagtgcttgcatttgcatataaagaaattgcagaagataaagaacttaatttagatgatgaaaatgcttttactttccttggacttatttcaatgattgatcctccaagagaagaatctaaagctgctgttgctgattgtataaaggcttcaataaaacctatcatgattacaggagatcataaaataacagcatctgccattgcaaaagaaattggaattttgcaaaaagatgatatagctatggaaggattagaacttgataaaatgtctgaagatgaactaaacgcatcattagaacatatatcagtttatgctagagtatctccagaacataagataagaatagtaaaggcatggcagaataaaggtaaaattgttgctatgactggtgatggtgttaatgatgctccagcacttaaacaggctgatattggtatagctatgggtattactggaacagaagtatcaaaagatgctgcatctatgatattaactgatgataattttgctacaatagtaaaatcaattactaatggaagaaatatatactcaaatattaagaattcaatcaaattcttattatcaggtaatatgtctggaatattaagtgttctttatgcttcaatatttgcacttccagctccatttgcaccagttcacttattatttataaatttaattacagacagtcttcctgcaattgcaataggtatggaaaaatcaaaaaaggatgtacttaaagataaaccaagaaatgctaaagaatcaatacttactaaagactttataataagtattacacttcaaggattagttattggattatttacaatgatagcttatcatatgggattatcaaagggttctgttggaacagctatgacaatggcttttgctactttatgtattgcgagattattccacggatttaactgtagagggaaaaaatcaatattttctattggacttttctctaatagattcagctggatggcttttggtataggtatagttttagtaaatgctgtacttcttgtaccaggacttcaaggattatttgaagttactccattagctctaaatgatatagttacaattcacgtacttgcatttatgcctactgtagcaattcaagtaactaagttaataagagaatttgtagagaaaagaaaataaaaaataatatatatgttgcaattgacagttgagaattgacaattaaggtgaaaatccttacaggatttttgaaattatatgcagaataattattgcaacatatatatattaattgacagtaggaaattgagatatgacaattgatgttgaaataactaagtgatttttagattataattgcaaagtttatagtgcagtaaatatataataaagtacctaaatcttataactatttataatagtatttataaggcgtaggtactttttataattagaaaactattttatttttaaaattccactttcagcaatccttgacactgcttcttcaataataggaacagggagaacaagagcaaatctaacgtaaccttccccaagagatccaaaagcacttccaggagtacatataacacctgtcttttccatgagctccatacagaaatcatttgaacttttaaagttagatggaattggagcccatgcaaacatgcttcctttgctgtcaggaacactccatcctattttacttaagcctctgcataatgcatttcttcttttttcatattccttgcagtgtagtttaacactatcttgtggtccagtaagtgcagcaattgcagcatgctggattggtttaaatataccataatcaatttgagaacgaagcattttgaagtgctttattatttcactattaccaactacaaaagatactcttgcaccagttatattaaatgattttgataatgagtagaattcaacacccacttcttttgctccttcatgagataaaaaagagccaccacatttttcatcataaactatgtctgaatatgcattgtcatgtattattattatattatgttttttcgcaaagacaataagttcatcatagaattctaaaggtgcggtagcacatacaggattcataggataagatactaccataaattttgttctttttaaaatatcttcatctattttgtctaggtctggaagataattattttctggaagaagagggtaataagctatttcagcgcctgaaagatatggtcctatttcaaaaataggatatcctggattaggtacaaggactatatcatctttattacataaggaaaaacctatatgcgtaagtccttcttgagaaccatacactgacattatttcatcaaagtttaagtttacattaaatctatttttataataagaaattaatgcatctattagttcaggcatatcatctaaagaatatttccagttctctgagttttttgcacaatttataagtgcttgctttacatgctcgtctggttcaaaatctggtgtgccaactgaaaggttgtacacttttttaccttgctttatgagttcagcttttttgtcgtttaaaacattaaatattcctgtctgaaagtattttagattatttgaaaattcaaaattcattgtttgttcctcctaagtatggtattggtttgattgcttaaaaaattaaattacatttagactaaagcaattacatattataatatattttacaattatattgtaataatggcaaatattttaacattatattattaatatgaaaaatatacttgttgttaagaatttaaagcctttgcaagaatggacagattatagtagaataattataatgaaaagacacggaatttgtattatttttgctaggaagaagagggaagtaaaatggaatttaatttagcacagaaaaggataataaacgctagagctaatggaataaagcttataaagggtgaagtttcatgcggtaagacagtttcagcaataaaaagagcttttaagcttcagcagttttattgtgttaataaagatgacgatattttaatacttgcaaaagatagtcatcatctaaaagcccttgaaagtattcacgaaagtatattaagcaaagcaataatacaaaaaagtttttttgatgacgagaataaaaagaaacttgaaataaataatattaattccattattttatcctattttagtagatataataaaaatcacaaaacagattattcaattgcagatattaaggtgtgcagagaagctttaaaagaagctataaagaaagtaaaagaaaagagtggttcagtttacaaaaatataaaattctttaatgaagagtatgtagaattttttatggatgaaataaaatggattaaagaatgtatttttacagaagaaaatgattattatgaatgtgatagaagttcaagacttaatattaagtatggaaaagaagaaaaacttataaaaataagaaagaattctaaagctaggaagtgtatttttaatataatgactgagtataacaggattttaagagataataatcttgttgattttgaagatgcagctttgtatgcagcagagcaatgtaaaaatgagaagaataaaaaatatactcatattgttgttgatgaagttcaaaattttactagaattgaacttcaaataatagatactttatataataaaaaaatgtattctactctgactttggtacttgatactgatagactggataaatgttgtggatggataaataaaaagagaaagttttcatctcttggatataatgtaaaaggaaaatctgtaactttaaaagaaaagtttattatgaaagacgatgcaaaaaaacatttgagtaaattaaatgttcataaaaagccaaaggctgtgaaaaaacataataggaacgatgacaaacagtattcttatagtcttttatctttcgatctatcaaatattgaaaagtgcacagatcatgatagtaataatatttttaatagtgaaaacaatatgttaaatactaataaaattaatgagaatatagcagcaggtgaaagcatgatggattttgaaactataaaatatatagatttaaatagaaatgtatgtcatgaatttataactgatttttatgaatgtggagaagtgtacacatcagatgataattttaagaatagagttgaagaagttgtaaccatacctgtctttaatgaaatagcagcagggagccctattcttatgaatgatgaagttgagtatagctgcaatattcctaaatcatggataagaggtagtaaagatttatttatattaaaaattaaaggtgattcaatggtaatgaaaaatataaatgatggtgatcatgttcttattaataagaataaatatccatgtactaatgatgtagttgcagttgaaattgaaggtgaagcaacacttaagacttttaagacaaaggggaaatatgtaatcttaaaaccagaaaatgataagtatgatccaataatacttaatggagaacaggaatatagtatccttggagttgctgtaggtatattaaagaatttttcttaatgtgagtaataataagactttgtgtaatatttaacaaaataaatgttctttaaacagttatataatagtgataattgcaatatattgatattaggaatattgtaaagggaatgtgattgtgaatgggacaaaatattatctataatgatgaatgtttaagttatgatgaagtatgtgagagattcagctatgttcaagatgaacacagtattgatgaggatttgggtaaaaataaagaaaaagctacatcatatgtatcccagtacacaaaagaagaaattgaatttatgttaaaggaatgtatatgcactactgttaaagagcttgaaaagaaagtagatgatatgtttagtggtgcagagagtatatataatactgaaataaaatcgtggaatgaagttcttgcaagtattaggctaaatgaagatataatagagcttaagcttactaatgattttgtgtgtgattctatgatagatataaattatatttatataactttatataaaaatggaaaaggtctatttactgagtgtattgaaaggataagtgaagaatatgaatttacaggttcttcatttatcccaattactgaaaatgaaatttattttaaggcacttgataaaaatgagtttattgacagagttttatcagaattaagataggtaaaaataaaaaagtacccaggatgtaaatgttttatatcactgggtactttatttcaagtttgtatttgcatatttatttctacaatagaagattgacagtgaaataacgaaaaatttataatatattttagggaaaacagaaaaaatgactttaaatagaggtggtaaaatgggattaagtgttaaaagaacttctataatttctttagaaagcagaatggagcttgataagaaaggtgtgggagttgatcttggtgggaaaaaactaaaagatttattggaaaatgcaaataaaaacaacaataaaaataataagactaaatgtaaagatgaagagttaaaaagtgaaaatatatcattagaagaaattaaaagtatgcatcaatattgtttggatgaattaaattggcaaggtataaatagtataaaaccaccatttgatataaattcagatgggcccaataagatagatgctttggaaaaatatgaaagcttccagccaggatttctttttagaatctttaaatttttagaagagaaaaaaaagagagaattattaaaagatattgaaattgcagagatgaaagacaaagccctttggggggattatgaaaaaataagtcagttaagccttcgagtcttaaatggagatttggattgctattttcaggttatagatgagataagaccatttgatagacttttaaaattaggaagcgaagtagaaatcggtacaaatgattcagagtctatggaagttgaatttaaggtgaattcagaaaaagtaattccaaaaagcagatttaataaagagatatctggaaatgatgaagaagtggagatcacttattatgaaatgatagaagaatatgtatgtagcagtatactttttgtagctaagaatattatgaacattatacctgtaaataaagttgtagtacatgctgttgataatgtggttgatattgataaaggtgctaagaacgatataacaatattatcaattgtatttgatagagaaactttaaataagctgaatattaaaactgtcaatcctatagatgctcttgattattttatatgcaatatgagacatcagaaagcatcagggtttaaaaatgttgatagaattgttcagtattaagttatgaggtggcaggaacttgatattaaaagattatactaaagaaatgattacaaatttaatagatattattaaagaatgtgcattacaagataagattacagtttctcttgaaggaagcagggtagaaaatcttcaatttatagaggagtataacataaatgaagaaaagctcgtggaaatattatcagaacttgttaaagaagatttctgttatggacttaagaatatgcaagatggtgtagtacataatgatctttatgtattttgtcctgtaaaagatctctacaatattaagggtgaaaaggaaagtgttgatatttacatgagatttaatatgatacaaagtgatgaggaaccttatagaattcttgtttcattacataaaagaaataaacccattacatatatttttaagtaaataacagttctagaagaggagaaaaaagtatgaaacaatatgctttttgtgaatactgtatgaagatgcagccatatatagtaaatgacatacatataacaacaactttaaatgatgaagaaatttcatatgatgggaaaaacgctatctgttgtcagtgtagaaatgaaatattcgtaaatgatatatgcagagaaaatttagagacattatatagtgaatatagaaaaaagaatgaccttatagaaaattataaaataagcatcattttaaaaaaatatgatatatcagaagaatctttatcaattattttaggattatcaaatgatgcagtttcaaggtatcttaaaggagacatggtatctgttcatgattcaaatgttttaaagaagatatataaaaatattcagtactattctttaatgcttgagacaaataaagataaaataaaggcttatgaatattgcagaagtagaaaagtagtaaaattcatgatgacagcaggaaaagttgaaagtaaggttgatggagtaataaaatatatacttacaagaagtgatgatgttactttattaatgattcaaaaactgatttattatgtacaggccttttattatgtgtttactgaacattttttatttgatgaagattttaaggcaggggatagaggaccattacttgaaagtgtatatgaaagatataaagtctatggttttgaatatataaataatgaaatactgaataatgaagaagtaaatcttttagatattgaaaagaatattgtggaaggtgttttgaaattttatggctgttatagtggaaagatacttgaaaagatggttgaaaatgaagcaccttggattcttgctaggaaaaaaatgttgaattgtaaaagcgaaacacacctagaagaacaaactgatattataagcaaagatgcattgtcagtatattttacaggtgtaaaagataagtatgaaatgattagtgttcttgacatggaaaaatacagcaaagatatatttgaaaaaatttctctttaatggtgcacatatagattattaatatattttgtggaaaaattacaagatttcagaatatactaataatagattaatttttaggagcagaaatatgaatatggattttcatgttcatggaattcttagtaagaagctgaattttgatgaggagttgtttatacagggaattaattttgctaaaaatagtggactacatggattagtcctttgtgagcattttaatgcaatagatatcgattcatctttttcatttcttgaagataattttatttatgaaaacgacagatatgatgttaatggattttatgtatatttaggtatggaagttgatataaggtatggaggtcatgttattgtatgtggccaaaggcaggaagtatataggataaaagaaaatcttaaaaattgcagaaaaaaagctgactttattcattttgaagatcttcttgatatggcagaggaaagtgagtgccttactataggaagtcatccatacagagaaaatcataaactttatcttcagagtgaaaaaaatttaaaacgtctagatgctcttgatttaaatagcaaggatatatacaaaagaggacttataactgttgaaaaagaagttgctgaactgtcaaaaaacatcaatgttccctatattacggggagtgacagtcactatcctataatgcttggatgtgttagaacatgttttgatgatgaagtaagaaatataagtcagcttaaagaagcaataaaaaatgaggagtatacaaggaagatttcagacgatttaaatcttaaggtttatactgcaaaggctgcaaaaaattatattaagaaaaaaataaaggaaaataaattaaagtagtctctttttgtcatatgaagaataaaatatcatatataaacgtgattataagagcgtaataaaaattaggagatgagagaaaagtgtgcatgctaagtaatgatgaattcatacttttagatgaattgatatacttggaatgggatgcatatgatgatgaaagtgtagaggaacttgtacttgatatattaaaggacgataatcttaagatacttatggataagatgagcaattgtgtggtttcatcaacaaaagaagaatgggaaagaacccttgaacagattttaactaaacctaatcttccaaaacttgttataattaatgttgaaaatcataaaagtggaatgaggacagcagcatttaaggattctgatgaaaatgtaattgtggttttcagaggaacaacgacaataaaagaatgggatgacaacggtcagggtgcatatgaatatgatacggagcagcagatttatgcacttaattatgttaatagcatcgattctgataagataattgtaacaggacattctaaaggaggaaataaggcgcagtacacaacagtacgttctcctaaagttataaaatgtgtatcaataaatggacaagggttttccaatgaatttataaataaatataagaaacttattgatggtaacaaagaaaaaattattgcagtaaattctaaatatgattatgtgaattgtctttttaattctgtagcaggagaaacacattacattaaaacatcatttcagtttaatcctcttttttatcataaaggaagcataatgcttgactatgatggtaatcttagagacgagaccagtaggagtatatttgcaaaaataataaatgatttttcaacttcacttgtatcggatcttccagatgatttaaaatcaataactgttgatggacttataagcggcatagaagcagtattatgcaaaaagcagtcaagtgataggataattaaaataataggcagtgttttaatcatgatgacttatggtaaatactttaagataaaggaaacatttgctttgagttatatggtaattcagtttttagttctaccacttttattttgggctgattttataaatgtggaagagactaaaaataaagaacttttaaaggatatattaaacaaaatggataaggctgcaatgactataataaataaacttaaattaacagaagatagtaagaatccaataagcaaaaacttatatagcaagtttgatatttttataaataaacttcatggtgcagtagaaagtttataagtattatgattttatttcattaattactgcaatgtaaaagaaacttattatttgttaaatataatgagtttctttttgtttttttatataagtatgttaaaatatgttacaatattagaagagttaggctaggttttgaaaggagtacatatgaagactacaataatgttaataagacacggagaaactgaatggaatatacttggaaagtttcaaggaagcactgatataccattatctaatgaaggaattagacaggcttttatgcttaaggaaagattaaaaagcgattttgattatatattttcaagtccacttaaaagagcttacgaaacagctaaaatattatgcgatgaaagtggaaaacatgttagtatagcagaagaaatcagagaaattaattttggtgaatgggaaggccttactgtaaaaggtatagcagaaaagtatccagatatatttaacgaatggagaaatgataagagagaaggaaaattttgtggtggagatatgagtactttaaatgcatccataagagcaaaaaattgcattatggaaatagcaaataagcataagggaaagaaaattgttattgtagctcatggaggaataatcaaagcaggtcttataggaatttttgaatgggatatgagcatgtaccacaaaatagcactaggtaacacatgtgtaaatactataacatttaacgatgatatgaaaccggctcttttaggattaaatgatacaaatcaccttgactgtgaggttactcaagtgtaatatacagagttttcaaggaatatagataaagttttgagataatatacagggagtggatgagttttggaatatactgatttatttaatataaaacaatttaataaatttaagcatgaaatacagtactgcaatgactttatgctttttaatcagtcgacagctattttaaaaaattcaataagctgttttccatgtcatccaggtctatactatcttcttgctcttacttatttcaagtgtaatgaatatattaaaggtagtgaatgtttccaaaaaggaattacatatgataaaaagagtaataggtatttgggacttgttagttgtatattttatgaaataaatgatgtggaaaattcatatagttatgcttacaaagcacttgaaattaacaaaaaggatattgatgctgtaataactcttggaagaattgaactttatagaaataattatgaggaatcattatcatatggaattatggcagtacaatttgatgattgcaatttttgtgcagtaagacttttaagcaaaatttatattgctatgggagtagaagaagaagatactttgaaaattctgtacagagcaagagagctgggtgtagattatgaacttagtcttgatataattaaagttttatatataacagaaaattatgtacagtgtcttaaagaatgtaggacatcgcttttagaaaattgtacaggatatgtagccaaggcaataaataaatatgttaatgaaatatcaacaagaacttttagcgtgtctgtgcaggatgttcaaaatatacaggaatctcaatcttcttatgaagtcagatcagaagatactgaaacagtagaacatgatagctatttaaaaagctgcaaaaagagtggaagcatcaatcgatttatagaaaatatagatactataataaaagctttagaaaatacggaaaattataagctgaaaaaaactagtgatgaatataaatctgattttagcaaatctaaatatgataatgtagactcttataaaagcactgaaaataaagataaacacaatgataaaaaaatggataaaaaaaagcctgcaaagaaagaagacgatttaactaagaaggaatcatcagagtttcagaaaaatagtaagtctaatgaaggtgaaagaaattcaaatacacttgaagaagccttagaaaaattaaattcactgacaggacttaaaaatgttaaaaaggaaattgaaagaatagtaaggcttattaaatatgctaaaaatagaaatgaagttcttaaaataaataaagagataaacttatcgtatcattttgcctttatgggaaatccaggtactggaaaaacaacagttgcaagacttattggtgatattttttactatcttggaatacttgaaaaaggacatgttgttgaagtagatagaagtgatattgtaggaaaatttattggcgaaactgcaaaacttactaaaaaggccatagataaagctatgggtggaatactgtttatagatgaagcatattcccttgcaaaaggcggagaaaatagtaatgattatggtaaagaagctatcgaaacacttcttaagtctatggaagataacagaggaaagtttacagttatctttgctggttataaaaaagaaatgagaaatttaattaatatgaatccaggacttcaaagcagaataaatcttatgataaattttgatgattatacagatgaagaattgatacatattgcgaaaaatattgctaaagaagagtattataaacttagtgaagatggtgaaaaggctttcattgaaaggatccagaaggaaaaagttgatgaaaattttgcaaatgcacgtgttgtacgtaatcttatggatgaagctgttagagaaaaggctttcagaactggtgatgaaaccgtatgtgaagaagagttgacaacacttacaagtgaagattttggagttgatttaaaatttactgcaagagatagtataaaagaatatgaaacacaacttgaaagtcttgtaggactggataatgtaaaaagtcttataaaagacatattaaacactgtagaacttatacatagaaaaaaggaaatgggaataaattgtgaagatgtctctttaaatatgattttttcaggaaatccagggacaggaaaaacaacagttgcaaggattgtaggaaagatacttaaagccatgggaatattaaaaaaaggacacatggtggaagtaacaaggtctgatcttgttggtcagtatgtaggtcagacaggtccaaagacccttgaaaaaataaaagaagcttatggtgggattctatttatcgatgaggcatatacattaaacagcggaagtgaaaatgattttggaagtgaagcaataggaactctcataaaggaaatggaagataaccgtgataaacttattgtaataatggctggatatacaaaagaaatgaaagaactattaaatattaatcctggacttgaaagcagaattaaatttaatattcaattcaatgattatagtggagatgaactttttaaaatatttaaatctctttgcaaaagggaaaagtataaaatttctcataatgcatataaaaaacttaaagaggattttgaagaactttcagaaaataaaggaagaaattttggaaatggacgtcttgtacgaaaatattttgaaaatgtgaagatgaagcaagcaactagaattattaatgaaaatattaatgaaaaagaagaaatgcttaaaataataaaagaagatattgattaaaaatagagtataatatgctagtaatgaaattagttagtaaacagtatttttaaggataaaggatataaatttgtatagtagtttatatcctttattttttattttagaagatttaaacgataaaaaatgatgcagcgattataagataaacagctaaaagttgtactccttcaaggtagttagattcaccatcttgtgaaactctgtttgcaattagtacagaggcaataagagctataagttcaaatgtattaaatattatactcataggagtaaagaaaagacttataaatataagaataggagctacaaataagattatctgaagacttgatcctatagcaatttcaagtccaacatccattttgttttttagtgccatgataacagctgtactgtgttcagcagcatttcctataataggaattaatataataccaacaaaaaattcactccatccaaggcttgctgtaatatcttctattccatttactaagaattcactttctattgcaattattattgttgatataacgagaacagaaatggctttttttaaactccattttaccttatcttcttcttcttcttcatattcatgtgtgtaaatgtctttatgggtattaaatgaaaaatataaacttaaaatataaattatcatcattactatagcaacaaatatacttaaaccttcatatcttgtatttaaaagtgcaggatcaactgaatgggtaaataatgcaggaatacataggcctataacggcaaataaaagcatacttgatgtaacttctgtaatttttttattgaatttttgagtcttatattttaaaccaccagccagcatgcttgcccctattacaagtagtatatttccaataactgctcctgcaatagatgattttaccacttcaaataatcctttttttagggcaaaaaaagatattataagttctgttgcattaccaaatgttccatttaaaaatccgccaatttttggaccagagtaaaaagaaatttcttcagtaccttcgcccattaaacctgcaaggggaattattgatccacatgataataaaaacataattgtaccagaggcatggaaaaattcagcaataaagcttataggaacaaatattaaaaagtattttaaaattttcataaagttatttcctttctgtggggtaataaagttaaggtaatatcaaagagaatataaggaatactattgctgtttatgtaataaatattatgtatttatattatccatgtgctttagaaattattataagaatttgtaatgaaaatttataaagtcataagattataaaaattagtttttgtttcaaagtaaaaaagacctataccaatttttatgttttatggtagggtctttttagcatctgaagaaaattattataatttattgaaaactaagagtttagttttgctgttaatatccatacatatttattcatttgaaggaaacttactttaaaatcttccttttcaaatatgtcttttagtacttcatgtgttgaataaaattcagtttctaaatcatgaagaagagataagcaatgagatgtttctgcatcttttaaaatgttctttttagattcttcagattcatacatggtatctgcaatgaccataactccatctttttttagtttatttttaaataaaatcacagcttcctctttttcatcatcagtcaagtgatgaaatgcgtagctgctaataatagcatcaatactattattttctataggaagtgaaaggaaggtaccaggaataaattttatatctggatatttttcagaagctatttttctcatttttatattaggttcaactcctacaatattgtatccaatttttgatgctatatttgtaagattacctgtacctgcaccaatatccagaacttttgcatatttatactttgaaatatgctttgctgtttcatttaatatctcattatagttatcaaacacttcattgtattcaccttctttagattcaactgtttcatcgtattcatcagcccagtcatcaaataatgcattaaatctgaaatctgataatttcatgttaaaatcatataaatgctggctgaaatatctatcacttctatcaggaagtataaccactatatttataggttcttttgctttatacgcttgtttaacagcaccagcaacagcagcacctgaagaagaaccagcaagcaccccttccttttttgatagaagacgaacaaaatacatagcttcatcatcttgtattttttcaacatcatctattaacgaagaatcgaatattttgggaataaagtgattgccaataccttcaactttgtaagttccagattcaccaccacctaagatagatcctacagggtcagcaaggactatttttatattgggatttttagattttaaatattgagcaattccggtaattgtgccaccagatcctgcaccagcaacaagcacatcaacttttccatctaatgcatcatatatttcttttccagtttttttatttgcttcaatatttgcaggattatcaaattgtcttgccataaatgaatttggaatttcatttaagagtttttcagctttttcaactgcaccttcaatgcctttatcagatggagttataataagttcagcacctaaagctttcattagtatttgtttttcaatagagaatttttctggaataactatgattagtttatatcctttttcaaaagcagcaagtgcaagaccgataccagtatttccagcagttgcttcaattattgtagaaccaggttttaaaaggccatctttttcagcagtttcaattatttcaattccaatcctgtctttaatacttccacctgggtttaaatattcaagttttgcaaaaatatttatatctttatttggtgtgatattatttaacttcaatagtggtgtgtttccaataatatctcgtatatcatttatataatgcatagtataatcctcctcttttattgaattgtataagaacgttattttatctaataaaataagtaaattgcatatttaactttaaaattatagtttaatattattgaattgtagtgctaggatttataattatttctttaacaaaagataacaatatatggttaaattttagagtagaatacttttagtgaaggcttgatcaagatcatctataagatcatcaacattttcaattccaacagaaagccttaggagattgtcaacaattcctgttttttttcttatttcatatggaattgcagcatgagtcattgttgatgggtgacatattaatgattcaacaccaccaaggctttcagctaaagttataagttttaatgatttaagaaattttttatagtcaataatatcttttgttacaaaggatatcattccaccaaaaccagaagcttgctttttttgtatttcatagccttttgaagtttttaagcctggataatatattttttcaacaaacttacttgctaataaataatctgctattttggatgtgttttcattatgcttgtccatacgaattcctagggtttttattccttgaagaagcatatatgaatcaaatggtccaagaatgccaccagtagaattttgaataaaataaagtttatctagtatttctttattatctttaacggcaacaagtccagcaactacattactatgaccaccaagatattttgtggcactgtgaattacaatatcagcaccaagatttaatggcttttgaagatatggtgacataaaagtgttgtccacaatagtcaaagattcatattcttttgcaaggctacttacattttctatatctgtaatatccattagaggatttgttggagtttcaacaaatactgccttaatcttatgactatttttatctttgtcaaaaattttctttatacttgataagtctgaaatatcaacaagttcataattaatattaaaatttttaaataccttgtctataactctgaatgttcctccataaagattatctggaattattattttatcgccacttttaaatagagaaagaactgctgtaattgcagccattccactgccaaatgcaagagcgccaatgccattttcaagaagagcagtagttttttctaatgcttctctagtagggtttcctgttcttgaatattcgtatttatattctccaagaccttgctgcttataagttgatgtctggtaaataggtacattgactgaaccagtaaattcatctccatcaactgctccatggactaataaagtttctattttcatatttaaatcctccttgtttggtaagtttatgtatttatatcaatcaataattcatattcatagtgtatgcacactattcctatttgtttacttgggattaatgaattttattttagtaattatgattagagttgtcaagaaaaattttaaaaggtcatgcataatgaaattatttagtgaaaataattattttattagaactaaggtaagtattgacagaataagaaatttaaagtattataactaaaaccaagtaagctgataagaattctataaggaattggaagattatttaattagttcttatgatggataatttcttatacataataaaaagcaataagacaatgggggaatagacatgccaaaattaagtacaagactagacggattcacagaatcagtaataagaaaaatgacaaggatatccaatgaatataacgcaataaacttatctcaaggatttccagattttgatccaccaaaggagattacagatagattaaaagaagtagcagatgaaggaccacatcagtattctgtaacatggggagcacagaattttagaaatgaacttgcaaaaaagcaaagtaaatttatgggggtaaatataaatccagatgaaaatatagttgtaacttgtggaagtactgaagctatgatgactgcaatgatgagtttatgcaatataggcgataaagttatagtattttcaccattttatgaaaattatacagcagatacaatactttcaggatcagaacctatttatgtacctttaaaaccaccttattttaattttgataaggatgaacttagaagagcctttgagcagaagcctaaagcaattattttatgtaatccttccaatcctacaggaaaggtgtttaccaaagaggagttagattatattgcaaaacttgcaattgaatttgatgtttttgtaataacagacgaagtatatgagcatcttgtatttccaccatacaaacatacatacatggcgtcacttaaaggtatgtttgagcgtacaatttcatgtagttcactatctaagacatattccattacaggatggagacttggatatgttattgcatctaaagaaataattgagcagtgcaaaaaagtccacgattttcttacagttggagctgcagcgccacttcaagaagcagcagttgtaggacttcaatttgatcaggattattatgataaattaacagaaagttatgatagcaaaagaaaattatttttagatggacttgataaaattggattaaaatattttatgccacagggcgcatattatgtcatggtagatatatcacagtttggatacaaaagtgattatgattttgcagtatggcttataaaaaatataggtgttgctggagtacctggatcaagtttcttcaaggaagatgtaaataattatataagatttcattttgctaaaaaggaagagacactcaaagaggctttaaaaagattagaaaagcttaaggagtatataaattaacagatgtgtattgcaattgaaatcagatatttttcaatgaatttttgttgttgatccttattctaagtaattaaggcgaaatttaaatgagaaagttcaactatttaaataaaaatataaaaaaaggttgacaaggttgaaaatggaaagtatactaagtttatcaacttaatagagacaacttatcaagagtggtggagggactggccctatgaaacccggcaaccgacatttagttcatttactatatgtgacggtgctaattcctgcagtttgtttaaactggtagatgagagaataattattgtgtgtatgtattacgccagagtttattctctggcgtatttttctttagtaaatttgttttcaattaattttgaaattaatatgtaatttctagagtatagttgtaaagttcatagtgaggcatacattatgcaatttcaattcagagtaacttgataatattaaatatatttaaataaagtaataagcatattcgaggggaataaaaatgaaaattttaaggaaattagcaatattaacattgacaggagtgataggcttaagtctaatagcatgtgggtcaaagacttcaaagaaagtaaatgatgcagcagatggtaaaaatataatagtcggggtgtgtccaggaccttatggggatatggttaaggaaatatttacaccattattagaaaagaaaggttacactgttgaagttaaagaattcagtgattatattcagccagaccaagcattaaataatggtgaaatttcagcaaacttaatgcagcatactgaatatttaaataaattcagcaaagataacaatcttgaaataagtgcagtaaaaacagtacctacacttgcaatgggaatgttctcaaataagtatacatcaatagatcaaattccagatggtgcaaaaataggagttccaaatgatgcttctaatctagcaagagccttaaatgtgttaagtgttcataatattataaaattgaaagataatgttgatgctacaaaggcaagtaaacttgatattgctgaaaatacaaaaaatattcagcttgttgaagtagaaggagcacaacttgcaagaagtattgaaagtacagatgcttcattaattccaggaaattatgcatatgcatcaggtcttgattattctaaagcattagcaatcgaaccattaacagaaaattataagaatgttgtagcagtaaaaacttctgatttagataaaacattaggaacagatttcaaagaaataatagaaagtgaagaatttaaaactgcaattgaaagtagcaaatttaaagatttttctaaaccagaatggtggaaataaaacaataagcataaagggggcataaacatgattgaattaaaaaatattagtgtggattttaaagataaaggacaaattgtacatgctgttgataatgtaagtttaaatataaataaaggtgaagtttttggaattgtaggtttaagtggagcaggaaaaagtacacttgtaagagtgataaatcttcttcaaaagcctacaaatggagaagtaataattgatggggaaaatattacaaatcttaaatcaaatgaacttagaaaaaagagacttaagattggaatgatatttcagcattttaatttaataagtgggaaaacaatttatgaaaatattgaatttgtattaaaagcagataattatcctaaggaaaagagaaaagacaggatagaagaactacttgaacttgttaacttaaaagataaaagagattcatatccggcaagtttaagtggaggtcagaagcagagagcaggaattgcaagggctcttgcaaataatcctgaaattcttttgtgtgatgaagccacatctgcacttgatcttgaaaatactgatgaaataataactcttttaaagaatattaaagaaaaaactaatattacaatcgtgtttataactcatgaaatggatgttgcaaaaagattatttgacaaagtagcagtcatgagtaatggggaaatagttgaaataaatgatgtgtacagtatttttgcaaatcctgtacaccaagtaacaaaatcacttatagaaagaaatgcaaaaatagaacttccgaaagaagtatttaatttaataaaaaatggagaaatattaaaagtaagctataaaggggatgaaagtcttaagcctattatttctgaggcagtaaagaattttaatgttgatataagcataattcatggaaagattgattatattggaggaaaacctcttggaactcttataataaatgttttaggagagaaagatgaaataaagaaagcaaagaagtttataaaggaaaatgcattttatactgaaagagttataaatcaatatttggaggtggtttagatggaaaatacaatagaaatattacaagcagagttaggtacagctgttttcgcatcattacagatgataattacagcaatgataatttcattttttattggaggaattcttggacttattttatatcttacttcaaacagattattttttaagaataagacattaaattgtgttgcaggttttattataaatataatacgttctcttccatttgtaatattattggtacttttaataccacttacaaaagttattacaggaactggaattggaccagaagcagcaacagttcctataacaattgcatctatagcattttttgcaaggttaagtgaaggagcatttaatgaaattgacaaaggtgtaattgaagcagcaatagcatctggtgctagttttgccctaatattaaaagacgtattaattgttgaagctcttccaagtctaatacgagctgttactgttaatttgataagtcttattggtttctcagccatggcaggaattgttggtggaggaggaattggagatttagcaataagatatggatattatagatatgaaaccggagtaatgattgtaactgttgttatattagttgttctagttcaatttattcagataagtggagattttatagcaaagaaatctaacagaagataatagaaaaggttaatacagataagcataagttaaaggaggtttgaaaaatgaattatgaagaactcaaaaatattgtcagtggcaacaatgcagttatactcggagataatattgaaaataagtatttaactgatggtcttggtataaaatatggaaaagcagaagcacttgtatttgcagaaaatgaagaagaagtaaaaaaagttatagaatatgcaaataataataatattaatataacagtaaggggtggagggacaggacttacaggtgctacaatcccaatttatggagggataattcttgatgtatcaagaatgaatagaattattgatattgatgaagaaaatatgactattactgtagagccaggagttcttcttaaggacattcagtcatttgtttcagagaaaaattatttctatcctcctgatccaggtgaaaagacttctacaataggtggaaatgtaagtactaatgcaggtggaatgagagcagtaaagtacggtgtaacaagagattatgtaagagagctaaatattgttacaggagatggtaaacttgtgactgttggaagcaggacaataaaaaatagttctggacttgatttaaaaaatcttataataggttctgagggaacccttggtgtaataacaaaaatagtattgaaaataattccaaaaccacaaaaatgtataagtattcttgttccttttaatgatcttagggatggaattgaatgtgtaacagaacttattaaatctggcagcaatcctacagcaattgagtttatggaaagagatgtggtatcaaattcagaaagatatcttgatttaaaacttccatatgatggtggaaaggcatttattcttcttacttttgatggagatgaaacatcaataaatattaataaagataaagccagaaatgcagtttttaagaaaaatgctattgattttgttgaacttaatgaaaaagaatgcgaagatacatggaaaataagaggggcattatgtagtgcagtgacagcaggaagtgagcagattccaatagatattgttgttccaattacaaaaatatgtgattttgcagagtatgcatcctttctaggtagaaagcataatataaaagtaatttactttggacatgccggtgatggaaatattcatttatgtgtagtaagaggtaatcttactgaagaagtatggaaaaacagttctcataattttcttttagagctttatggaaaaagtcatgagtttaaaggaattccatcaggtgaacatggtattggacttgataaaagagaatattttttatgtcatgaatctcaaaataatatagatataataagaagcattaaaagtgtttttgataaaaacttaattttgaataaaggaaaagtatattagatgaaagatacattaaagagttctaaggttataaattagagctctttatttatatataaaatctttagttaaataataaaattgtacttgatgaatagattttcaaaattaggacattgaaattactattgtttgatgattaaaaatattaagaacatattttgattttcagtttaatatctattagaatatatattaaatgataatatttaaatagagttttaaatttgaaatactatgggagctttttatgaatagaaaaaataatgaagaaataagagaagacaaaataaaaaatctatttagtgtctatcctgtgttgaagatgattgaagaaaaaaatgaaggcataataaagaacaatgtacagtttaggactttacaagcagatgaagatatatccagtaaaggtaaaggtacgtgtcagggaattctttttgtattaaatggaaatataaatataaagagaataaatgaagatggcgatgaaacaaacctatacaatattggtgaaggtgaactttgtcatgaagctttaagttgtcttttgagttataaaccattaaatataatggggattgcacttcaaaagtcagaaatatgtatagttccaatggatatagtaaagaaagtccttcttgaaagcagtgaatttttaagttatatgtataaagacatttatgaaaaattcacagttgttattgaaaaaaaagaagataaaaatcataaatctgttgaatcaagaattgttgaatattttttaaataagaaaacaagcataatatatgaaactcataaagatatagcttttgaaatagattctagacgtgaagtggtaagcagaaagcttaaactttttgaaaaagaaggatatataagacttgaaagaggtaaaataagcattttaaaagatttaaatgaaattttaaaaaagattgagatgtaacgatgaacaattttaagttgctttaattgttaaaggccgagttatccataagttgataaataatttaatattatatataaatggatagtaatttataaaaatcaagtgaaaaatcctgagtcagtaataaatgacttaggattttgttgttattgaagaaattgttctcattcaagcataatttaaaataacatcattaaccatagattttatcacccttttgaatattttttattatttcagctctttcctcatttaagagggcgtattcttttaaagctctcatttcaaagtatgctcgtttcacatcatcattacagtagattaatgaactagtacctattatttgtgctttgaaaactgtagaggccttttttaaatctattaaatcaacatctcttttaaatatttctgcaagttcttgagctttcataaaacattcatactcatcaacatctaaaaaacttaaaaaagcaatatctatatcactttcaggttttaattgattcttagctgcagaaccaaaaaggtagactgaaattatgttaaaatctttaagtaatagaatggatttgtttatattttcctttaagttcaatttgatcacctctactttacaagcgtttatttcaattatagcataaacacatctaactatacaaagagggtttttaacaaagagttaattttaaagagaggaaaagtataattaatgttttgtaaaaatagaaacttatgaaattaaatttaagtttgtatcattattaaagtaaatgatacatcccaatttaaagtaaggattatgaaattacatactaattaaatggaattaagtaccaaaataacaaaaaacactttgtactatgtttataggctaattaataattatagtagttttatgttaataaatttgtattttaggactttgaaacacaattttatacttgcataagcaatatttgactaatttggtgaaagtggtgaaaagacatgaacaggaaaaaaatatcaattattttaagtggaattatgggaattatgactttacttccaagtagtgcatacggaacttcaaataatggatgggaaaaaataaatggaagctggtactattacgaaaatgggaatagtatatcaggatggaaatatgatcatgaaaactggtactatttaaataatgatggagttatgaaaacaggctggattaaggatgtgggcgactggtattatttaaatgatgatggaagtatggctaagggatggaagttaattgataatcaatggtattatttaaatagcaacggttctatggctcatgatacggttattgatggatatactttaaattcaaatggtgtttatattgaaaataaaaagaattatacttttacagaaggacttaataaattctgtctagattcaggtgcaatgatcttagctaatgaggataaaaatctaaatacatcatactcaccattaagtttttacatggctcttgcagtattaagtgaaggttcagataacaatacaaagactgaaattctaaatggattgaatgtaaatgatgaagaaaaattaagtgaagagtgtagaaaattatatgaaaaagaaagttttgactctaagtatggcaaatgtatattagcagattctgtatggattgatgatgataacaatgatataaaatttaatgaagatactttaaagaaaatagaaaatgattataatgcaggcatatttaaaggagatcttcaaagctttaatacagctaaggatataagtaactggcttttagaacatacaggaggacttttaggtggaaatccttctgactttataagtgatgaaggagcagtaatgaacattattaattctgtttactttaaagataaatgggcagatgtatttaataggaatcttactgaagaaaaagacttttgtttgagtgatggatcaaaagttaaaagtgattttatgtctaataatatatatagtaaaatttatgaaagcaataatggatataaatcttcaagtcttaaatttgaaaatggtaatgaaatgatgtttattcttccggataaaggaacatctgtatatgatattataaatgataaaaacaaatttaatgaagctctaaattcattatcagataaaaatgtaatcatggaggatgtacattacaaggttcctaagtttaaggtttcatcaaaactagatttgaataattgtgcaaaaactttaggccttgaaaatatatttaatggaaaaactgctgatttttctaaattcagtgaaaaaggtggattagctgtttcaagtatatctcaggaagcaacagtatctattgatgaagatggaggagaggctgctgcatatacagaaattgaaatggatggatgtgcttatgatccagaagcaaaatcttatgatatgacactagacagaccatttatttttgctattactgataaagataatactcctttgtttttaggagtaataaataatccaactgtttagttatttactacaagatgcaagtggaaattatttttaagattatttaaagaatagtatagaaaattaaaaatgaaatttcaaagtagctgtatcaaattaaaagaacttcaatttgatacagctactttatggtagaagtaaatagtgtattttttaacatcagaatatacaaaaatctaagttttaagtattagtgattactatagctatttaacaatatatgcattgacattgtttacacaatatgttatttttaaattgagtaatcggttaactaaaggagaatataatgacagtaacaataaaggatgtagcaaaagcatcacatgtttcggttgctacagtatcaagagtattaaatgatctaggaggatattctgataagacgaaaaataatgttttaaaagctgtagaagaattgggatacagaggaaatgctattgcaagatggctttctactaacattactagaacaattggaataattataccagatgtgtcaacaaattttgatggagaaattataagaggaattgaggatgtagctcataataataattacagtgttataatatgcaatgcaggtactgagggaaagcgaacactagaatatttaaaaattctagaagaacgtaaattagatgccataattatagtaagtatagaaataacagaggaatattataaagttataaaatctatgaacatcccatatatattaatatctacaatgtcattcaaacacaatatgccttatataagggtagatgatacaatggcagcgtatacagcaactaaatatttaatagataaagggcataaaaatattgcaatgatcagtggaacaaaagaagataagatagctggatggcctagagtgcaagggtatttaaatgctttaaatgagcataatttagaagtggatgaagaattaataaaatatggtgatttttcttacgaaagtggtattaggtgcattgatttattgttggatactaaaaagaaatttactgcagtatttgttgcaagtgatgatatggcagcaggagtattaaatgcaacttatagaagaaaaataagagttccagataagctctcaattattggatatgataatactaaaacagcagagatgtctataccgccattaacaacattggctcaacccctgtatgaaatgggatgtaaagcatttattagagtactagatatgataaatggaagagattctatggatggtacaattatgaatcatagtattattgagagggaaacagtaaggtggttaaaataaccactttatttatcaaaattacgtaatcggttaactaaaatcttttaagtaatcgattaactatattataaattagctattaacttttacgtaaccgattaactataaataattttatataaagggaggaaatgatttatggaaaagaaatggtggaaagaatgtgtagtatatcaaatatatcctagaagttttaaagatagcaatggagatggtattggtgatttaaaaggaattatagaaaagttagattatttaaattatttaggaatagatgtaatctggctttcacctgtatataagtcaccaaatgatgataatggatatgacataagtgattatcaaaatataatggatgaatttggaacaatgaaagatttcgatgaattacttagagaatgtcataaaagaaatataaaaataatgatggatttagttgttaaccatacatcagatgagcatagctggtttatggaaagtaaaaaatctaaaaataatgaatatagagattactatgtgtggaaagaaggaattaatggacaacctcctaataattggggatctgtatttagtggtccagcatggcaatatgatgaagaaacacagatgtattatttacatttattctcgaaaaaacaaccagatttaaattgggaaaatccaaaactaagaaatgaaatttattcaatgatgaaatggtggttagataagggggttgacggcttcagaatggatgttattaatttcatatctaaagatcaaaatttcccaaatggtgaaaatggtgattttggcccttatgctatgaatggaccaagaatacatgagtttttaaaggaaatgaaacaaatggtattaaaagaaaaagacttaataacagttggtgaaatgcctggagttactgtagaacaaggaaatttatatacaggaaaagatagagatgaacttaatatggtatttcaatttgagcatatggatattggtaatggagagtttggaaaatggcataaaaattcatttaaacttactgaattaaaaagaataatgactaaatggcagaaaggattagagaacaatggttggaacagtttgtattggaataatcatgatcagccaagagttgtatcaagatttggtgatgacaaaaagtattggaataaatcagcaaaaatgttagctacgtgtcttcatatgatgcaaggaactccttatatatatcaaggggaagaaattggtatgactaatgtagcttttgagaagttaagtgactataaagatatagaaattttaaatgcttatgaagatttagtagttaaaaaaggtagatctcatgaagagatgatgcaaggtatatatgatagaggtagagataatgcacgtacaccaatgcaatggaacgacagtgaaaatggtggatttactttaggaacaccttggattaaggtgaatcctaactataaatctataaatgtagaacaagagataaacaatgaagattcaattttaaattattataaaaaactcataaaaataagaaaagataatgaaattgttgtttatggtaaatacgatttgttattagaagaaagcgaagaaatatattcatatatgagaactttaaataatgaaagattattggtaatttgtagtttctctaaagaagaaattacctttaacttaccatcagaagttgagtataattctaaaaaattgcttataggtaattatgatgtttgtatagatgaacagttagaaaatataaaattaagaccctatgaatgtagagtttatataatttgaaaaacagcaaagttttataagaaaaatgcctaattaattctaaaaaaagtataagtaatttctaataaaaatattaggaggtgaattctattttcatattgaaactaaaaataaaaaagacacttaataaaatatttagtaagacgtttataaaagttagttgtatgaaaatagttgttatgaaaaaaaatctaaaaaaatttattagttactcaattctatgtactttatccatgtcaattctatttggttgtggtaaatcagataatataaataaagaaggaaaaagacaagttgaagtgtttttgactaaagcagaagctattggaacttttaaaaaatttgaagaaaaatttgaagaagaaaatccagatattgatgtaaccataaactgtccagctcaagctatgactgttttgaaaacaagattagtaaaaaatgatataccagatataataactatggctggggagttaaattatgcagattttatagatgcaggtattttagaagatttatctagtgaaaaagaaataatagatagaatacaaccagcatatttagaagtattaaaaagtttagaatttgaaaatacagatggagtatttggtattccatacgcttgcaatgcaggtggagtagtatacaacaaggatatctttaatgaacttggtttaagtattcctagtacatgggatgaatttatacaattatcagaaaatataaaaaatcaaggtatagtaccattttctttctcattgaaagattcatggactgcaatgccagcgtggaatgcaataacagctaatacacagccaattgatttttttgcaaagcgtagagaaaataaaaatacatttaaagaagtatataaaccaatagcagagaaaatatctcaattaatacaatatggtcataatgataatttcggtattggatataatgatggaaatgtatcttttgctcaaggaaatgcagctatgatgatacaaggaaattgggttattcctgaaatattaaaattaaatcctgatgcaaatataggaatgtttgtactacctgtaaataatgatattaaaaacaacaatgtagtatcaggagtggacttgttattttccataccaacagaagcaaaaaataaagaagattcaataaaatttattaaatttatgacagagaaagaaagtatggaagcatatgcaaatgagcagtttgcaattccagcattaaaggatatgtatcaagaagataaaactgtagaagacttaaagccatattttgaaaatggaaaagtactagatttcccagatcatcattatccttcatcaatgcaagttgcagatttagcacaaggatatttatttgataatgacatagataagttattaaatagtttagatgatagatggaatagagctcaaagataaaataaattgaattagtgtacaagtaagtacaccagatatataggagtgataaatgtgaaagaaagaaaacgagtatttttattaatgtctttaccagcagttatattattctttgtatttcatacattacctttattaaaaggtatatcttatagttttacaaattggagaggctttggagattttgattttgtaggttttaaaattactttagtattttttctgatgagagaatagttaattcatatatgtttacaattaagtttgcaatatttgcaaccataatagttaatataataagtttaggattagcaataggacttaattctaagataaagtttaaaagcacattaagagctatatactttatacctaatattttaggtggattaatagtagggtatattttcaactatatatttacattcatattaactgagttcggacaagcaattggaagcgaagtattaagtaaaagtatacttggagatcctaatctagcatggattggagtagttattgttgcggcatggcaagcaatagcattcaatacaataatatatatatcaggtcttcaaactatttcagaagatgtatatgaagcaagttctatagatggagcaagtaagtgggttcaattcaagaaaataacattccctttaatagcaccattctttactataaatatggttcttgctatgaaaaatttcttaaacgtgtttgatcaaataatatcattaacaggtggtggtccatcaggctcaacagaatctattgctgtactaatatataaagctggatttgaaggaagccaattcggatatcaatcagcaaactctgttatatactttatagtagtcgtagcaatatcattactacaactaaaaattcttgaaaaaagggagatggagttataatgggacaattatctacaacaaaaatattaaagaaaaaatttaaagataaagatgaaaaatcaaattggcctttaactatattaatgttaataggaacagtgacaatcatattccctttaattataactgtgctaatagcattaaaatcaccacaagatatgatgggtggagttttatcattaccagaagtatttcattttgaaaattttaaaaatgcaatagaaatgactaacttctttaacgcattaaaaaatagtttatttattacaataacaactgttatttttacagttgtaactaattccatggttggatatgccattgcaagaaatttacacaagaaatcatacaaagcaatttattactattttattagtgcaatgtttgtcccattcccaattataatgcttcctcttgtaaagcaagttagtagctggaatatggataacatttttggagtattattactatatatagtttatggattatcatccaatgtatttttatatgtaggatttttaaaagctattccaaaagaattagaagaagcagcatttatagatggtgcaagtacttggcaagtattcttcaaaatcgtatttccaatgtgcaaaccaatgcatgcaacagtagcaattatgacagctttatggtgttggaatgatgttatgcttccacttgtaatattgagtgatccaaattttgcaacaattccactggttcaatttatctttcaatcacaatttggaactaattacaatctagcatttgcatcatatttattagcgttaattccaattttattattttatttgtttgcacaaaaatggataataagtggagttactaaaggtgcaataaaataaacttaatgaatatttaaacttattgtaatataagaatgtaagtttggagagcatgttttgagaagttcctaaaggaatcataaaaaaattatggttcctttttggcgtatgaagaggcttttatgaccttatattatattgactattaagttatctacataagttctaataatttatcatgtgaatataaatataaatgagaattttatagcaaaaggaaggtatagaatggataaaattgattccatactagaaaaatatgattataatagacagcttcttattgcaattatgcaggacgtgcagaaagaatatcattatctaccagaagagatattatcatatatagcagaaaaacttaagataagcgaagcaaaaatatatggagttgctactttttatgaaaatttttctcttaaaccaaaaggaaaatatgtaattaaaatatgtaacggcactgcatgtcatgttagaaaatcaattcccatattagaagagttcagaaatatattaggattatgcgaagaaaaatctactacagatgatatgatgtttacagtggaaacagtttcatgtttaggggcatgtggacttgcccccgtgtgcacagttaatgatgaagtatatcctaatatgacaaaggcaaaagtaaagttacttgttgatgatattaaaaaagattttaaagcaaaaatcctaacttcaaaggaggatatatcttatgaagattaattcaagagaagaacttgaaagaatccgaaatgattatagaaaagctttaaatagtcaggaaaagcagatacttgtatgtgctggaacaggatgcatggcaggtggatcaataaaaatttatgagaaattcaagaaaattattgaggaaaagggccttaagcttgaattaaaacttgaaaaagaaatagaacatcctccaatagaaattaatactaaaaatggagaaaaagaagatagcagtaatgatgataataagacagcatcaataaaaaatagaaagaatgagattataggtcttaaaaagagtggatgtcatggattttgtgaaatgggaccattaataagaatagagcctgcaggaattctatatgtaaaagttaaggagagtgactgtgaagaaatagtagaaaagagcataataaatgatgaagttattgaagaattaatttatagtgatggaaaaaaaggatacagcagacaagaagatatacccttttataaaaatcagactcgtgtagcgttagaacattgtggacatataaatgctgaatctattgatgaatatattgcactagatggttataaagctgttacaaaggcactttttgatatgactccaagtaatattatagatgaaatcagtgaaagctctttaagaggaagaggtggaggtggttttcctactgggataaagtggagtcaggtttataaacaaaatgaaaatgacaaatatattgtatgtaacggtgatgaaggtgatccaggagcgtttatggacagatcaatgatggaaggtgaacctcatagaataattgaaggaatgataatagcgggcattgcaacaggtgctcataatggttatatttatgtccgagctgaatatccacttgcagttgaaaggttagaaaaggccattgaacaagctgaaaataaaggacttttaggtgataatattttaaattcaggatttgattttaatattcgtataagcaaaggagcaggtgcatttgtttgtggtgagggaagcgcacttacaacatcaattgaaggaagcagaggaatgccccgtgtaaagccaccaagaacagtagaaaaaggattgtttggaaagcctactgtccttaataatgttgaaactttttgtaatgttccacctattattcttaaaggagctaactggtataagactattggaacagaaaataattatgggacaaaagcctttgccttaacaggaaatgttaaacacacaggtcttattgaagtgccaatgggaacatcgttaagagaaatcgtatttcgcattggaggaggtgttaaagatggtgaatttaaagcagttcagattggaggaccttcaggaggttgtctttgtgtgaatgctggacatcttgatttaaaacttgattttgattctttaaagaaagtaggtgcaatgataggcagcggaggacttgtcgttatgaatgacaaaagctgtatggttgaagtagcaagatttttcatgaatttcactcaaaatgaatcttgtggaaagtgtgttccgtgtagggaaggaacaaaaagaatgcttgagattcttacagatatagttgaaggaagaggaacaaatgaacatattaacatgcttgaagagctttcagatactatttcagctacagccctttgtggacttggaaaaagtgcatgtctaccagttaaaagtacattaaaatattttaaggaagaatatacagcgcatgtagtggataaaaaatgtccgggtggagtatgtaaagctttaatatcttatgaaattaataaggataaatgcagaggatgttcaaaatgttcgagaaattgtcctgttcaggctatacaaggagaaattaaaaaaacctttgaaattgataaagaaaaatgtattaaatgtgggcagtgtattatagaatgtccatttaatgcagtagaagtagtctaggtgaggtggaggattttatggggaaatacatgattatagatggaaatcgtgttgaatttgataaggaaaagaacattttagatttagtaagaaaagcaggaatagatcttccgacattttgttattattcagaattatcaatttacggtgcatgcagaatgtgtgcagttgaagatgaaaagggaaggataattttttcgtgttcgtcgcctccaaaggataaaatggtgattaagactaatacaccgaaactttatgttcataggaaaatgatactagaacttattttagcatctcattgcagagattgtacagtgtgtagaaaaagtggaaaatgtagacttcaggaacttgcattaagatttggagttgataaaatacgatttaaaaatacaaagaaaaagctctcaatagataattcttcaaaggccatagtaattgattctagcaaatgtattttatgtggagattgtgtacgtatgtgtagtgaagttcaaaatgtaggagcaatagattttgcatttagaggttcaaatatgatggttagtccagcatttgggaagaacttgtctgaaactaactgtgtaagctgtgggcaatgttctgcagtatgtcccacaggtgcaattacaataaaaagttgtgtaaaagacgtatggaaagccatatatgaaaaagataaaagagttgttatgcagatagctccagcagtaagggttgcacttggagaagaatttaaaattaaatctggtgaaaatgtaattgataaaatagttgcagtaatgaggagacttggtgttgatgaaatatatgatacatcagttggagcagatttaactacacttgaagaaagcaaggaatttttagaaaaaataaaattcgaaagtggatgtatttctatcaataatgatttaaaacataaagatttagatgtggtagactgccataataagaatattaaaaaagaattttttgaaaatcgtagaaatattagatatcctttattcacatcatgctgccctgcatggtacaggtatgctgaaactaaacatccagaacttatgccacatatatcttcgtgtaaatcaccaatggaaatgtttggtgtagtaataaaggaatattttaaggaaagggacataaaggaaggaagagaaaccatttcagtagcagtaatgccttgtacagctaaaaaagcagaagcagatagagaagaatttacaagagatcatattaaagacattgattatgttcttacaacaagtgaattgtgtgacatgataaatgaaagtggaataaagtttgatgaagtggaaggggaatctttagatacaccattttcattatattctggtggtggagttatctttggagttacagggggagttacagaatcagttatacgtaccatatatgaagatcaaagtcagaaaggattaaaggatttgcagtttgtaggcatgcgtggtatggatggtgtaaaggtgtgtgaaatagaaataaatggacttcaattaaaaataggaatagtaagtggtcttgcaaatgctgaaaagattatacagagtattgaaagcggaaaagagtattttgattttgttgaagttatggcatgtaatggaggctgtattggaggagctggacagccatttggattaaataaaactaagatagaacgtgcaaaagggctttataaggctgataaggttgcacaaataaaaagaagtagtgaaaatccaatgatggatacaatatataaagatattttaaaaaatagtaataatcttttacacagataattttcaaaagatcctaaaaaaattaaaacatcttaaaaaagtgatataaaaatctaaaaaaatttacattgtcaaatttttaaaaatgatataattaaaaagggtagcacacccacaaatgtggaaagaactcattttcatattagaaaatttaattccacatatatataaagaagctgcattcatactgatttattcttatgaatatggtttcttttatttttatattaaaagttttacttacctaaaaggcttttttctgatataatagaatttagaactaaaaaacacgcctttacatgcgcttatgaattaaataaattttaattaataagttgattttttattaaaaaaatgaagttataattcataaaaatatggtttttataatttgaattttgtttatgagggtgtgtaaacgttatcaaagaaatggaggagtaaaaatgttcaaaattgatgattatgttatttatgggggcaatggtgtctgtaaggtgactgatgttggggttcctgaaataagtaggtttgacagtgaaaaggaatattatactcttgaacctgtatatgaaaatgggagaatatttgcacctgttgataatgaaaaagttgtaatgagaaaggtactaacgagacaggaagcagatgatcttattggaactattccatctgtagaagtaaattggattgataatatgaaagaaagagaccatgaatttaaggatataatacaacattatgattgcattggattcgtaaagataataaagactataattgaaaagaaaagagaatacagttcagatgggaaaaaactatctgtaagtgatgcaaactatctaaagagagctcaggaatatctaagcggtgagcttgcaattgccttaaacatacctaaagacacagttaacaattacatagagaatagattgaaatgcatgtaagataaagatatgataaaatcaagaatactaaaaaaattatttaaaattaaacttcagcacaagattattactgaagtttaattttttattatatacattgaaattgacatgttatgttcagtgtaggtattccttgttagtaattgtaaagtgcatagtgcaatatttatttatatagatgtaatgttaataacaacaacttctggattgttgaatattcttggtactggtgtagactctctagcaagtccacggcttacaattaatgtggtgtctttaaagtcatatctaccacctgcatatttaggaaaaagcccttgatgaggagctattactccattaattaattttggaattcgccattgtccaccatgggcgtggccagataaaacaagatcaaaatcatatttacgatatttatcaattaactcaggtctatgtgaaagaagtattgaaaaattaccattatcacatgccttggctgtgttatcaagttgtttgtaaaaagaattctttgcaatagtcgggtcatcaacaccacatatattaattttttgaccattgatttcaagggtatcataaataccatcaagaatagttaaaccgtatttttcagtagcttttttaacctcttgtgtattttttaaagtctcagtttttgaatcatgattgccagttacaaagtagcatttagaaatactgcttatctgctttaaaaatgtctcagtatttgcattatcagattttttatcgttgtaaatatctccaccaagaagcaccaagtctggattctgactttttatgtcttcaataagtgtattcatattatccccataatagcaagaatggagatcagttattaaaactatttttaaatcattgtttattttgtttgaagctactgtataaggaacgattttttcttttatactaaatattccaagaataaatattgatgttaaaattatcatcattagtttgattagaaaaacaattggttcataaatcatatgaataaaccttaaatattccatgtataattatctccagtaataaattagtatttataagtagtaatctaaaacttcaattattactttttaaaacttaatactattttagcttattacatgggggaggcgtcaatagattaagtcttaatatttgtttaagattaacttaatttataaacagggttattaataattaaattcatagattgaatgttttcaaatttaggaacggacaaaactatttaatatcattccaaggacaacgataatgagtcctataaggcttagtgttgtgggaattgtatcatgaaatataagaattcctccaagaagagtaaacacaacttcgccagcttgagttgactctattatagcaatattatgagaattatctttaacaatatcagtggctttaaaaaataatatagttgcaattattccagaaaagacagctactatgaatgattgtattaactgactttttcctggaagtccagaatttgaaattcctaaaagtgatattattatccaaaatggcatactgcataaagtcattccaaaaactctttgtatagtatttatattactatcacaaatctccatcattttacgatttccaagtggatatgaaaatgcagctattataactggaataataacaagcattgtatttagcaaagaaatatcagtagcttcttcaatatacattagggctattcctaccaaaattagtaatgatatgagaagagactttttggggattttatttcgtatttttactatacctttttctgtttttataatcttaaagaataatggtgacataagaccaccagctactattgtcaattgccatgttccagccacaagccatgatgcaccataagatgaagcaaaacttaaaggagcataaaaaaagccaaatcctatagtactccacaaaagccatgataaaggctttttacgaatatcaataattacttcctttaattgtctttttgaaatcattataataagaagcattggtaacatgaagatatatcttaaagatgaactccaataccaacttccacctgaaagatgcatctgttgatttaagataaaggtaaatgcaaaaaagaatgatgaacaaattcccagcataaatgcttttttcataaatataaacctccaaaatttaaatgtatgttataacatatataattataatatattatacaacatgggatttacaaaaacaataagttagaataaaatatgttataacagacacaattttaaaaatgtaatgaaagagagtgttgaatatggaaaatttaactttggttataggaaataaattaaaaaatattagaaattctagaaatttaagtttggatgatgtggcagaattgacaggtgttagtaaagcaatgcttggacagatagaaagaggaaaatcaaatcctactgtttcaacattatggaagatttcaacgggacttagggtgtcattttcatcttttattgatgaaagcaaagaagaacttagagttataaatatagatgaaatagaaccggtaattgaagaagatagtacaatgaagttgtatccgatatttccttttgatcctaataggggagttgagatatttaccatagaacttgaaaaaggatgtattcatgaatccagttcacataacagtggagttgaagaatacattattgtaactgaaggtgaaattgagatgaccattggagaagaaaattttatattgaaaaagggatgctcaattaaatttatggcagataaaaatcatacatataaaaatttaaatgaagataaggcagtttttcaaaatataatattttataggtaaattaagaatatttctctaaataaatagatatattgatacatcagtaaattatattcatttagcaatataaaataaaggtggagagtatgagaagaatgttaaatagaagagctaaaaagaaaagcatattttttatatgtatatttttagtggtattttcagctataattttaatatttagcagctgtagtaaagatatatataatgacgataaaaaaatagctgaacaaggtgattcttatagttatggcgataaaataggaagtcaaaaatcaaataatgacttagatttaaaattcagtggtttttctggttacgatacaatattaatattaaaagtaagtgaagacagcacaataacattgaattatgatttaaatattaaaagtggtaattttaagcttgtcatggtaagtcctgataaacacattgaaaatatacttgaagaaagtgcaacaggaaataaaaatatagaattaaaaaagggcgaatacagatttaagattgttgggaaaagttcaaaagggcagataaaaatttcatttaatgacactaaaaatatagaagcaataatttcagattaatgatttattaaattaaatctggattaaagttaactatctatatttattttgttataatttaaatgttattatagaacatcaatagaatattaaaggaagatacaacagatgaaagtttttaattataataataagcttcaacaaaaagaatatttatatgaaggattttcaatagatataaataaaaagaatgtaatttcatttgttggagcaggtgggaaaacaacattaatttataatatggcagaagaattaatgaaacttgggaaaaatgttattataacaacaactactaatatgtttatatcagaaaaatacttcttatacagcagtgatttagttgaaattaagaaatatttaaataaatctaaaatagtggttttaggaacaccagtaggcaataacaagtttacttctttaactaatgttagttatgatgaacttatagaaatatgtgattttttattaatagaatctgatggttcaagaaggcttccattaaaagcaccacatgatcatgagcctgttataattgataaatctaacattgtaataggtgtagctggaattgattctgtaggaaaatcaataaaagatatatgccatagaaaggaagttgtatgcaatattttaaatgttgatgaatctcacataattacagaggaagatattggagttttattatccagcaataaaggacagatgaaatacatagaatcatttaatggaagtgtaaattatgttgcagcaataaataaatgtgataataaatatctcatagataagggaaaaaaaattagtgaattattaaatgaaaaaaatataaatagtgttattacaagttttaaataaaaatctgttaggtagacaatattactataatgttacctggcagtaaacaaggggatgaaagtatgattatattaataaagggagcaggagatttagcaactggaattgcacatagattaaaagtttgtggttttgatgttataatgactgaaatagctatgcctacaactgtaagaagaacagtagctttttctcaagctgtttttgatggaattgctgaggttgaaggtgttaaaggaattttagtcagtgatgtgaatggagcctttaaagttatagaagaaggaaacataccgatagttatagattcaaaagctgaacttataaaggaattgaaaccccatattgttgtagattcaatcataagcaaggtgaactgtggcaatacaactataaatgatgcacctatagtaattgcagttggaccaggttttgaagctggaattgattgtcattgtgttattgaaactcagaggggacattatttgggaagaacaatttataaaggatctgcaatagctaatacaggtattccagggaatataggaggatatactgtggagagaataataagatcatctggtgatggttttattaagcctatggtggaaattggtgaacatgttgagaaaggacaagtggtcgcaaaggtagttaattcattagagtgtgatgatagtagtgagcctgtttttgcagaaatatcaggtatagttagaggaatgcttcaagaaggtgtaaaagtacataagggaatgaaaagtggggatattgatccaagatgtgaaaaaaagcattgctttacaatatcagataaggcacgttcaataggcgggggagtattggaagctgtactaacattgaataagcaattatcaaaataaaaaataaggggaatatgtatggggaaaagattatataaacaagttataagagaattaaatgaaaatggatttgttaagaccttaactgtcataagccagaatgaaaatataggtaaaaaaattatagtaaataagaatttgaatgattctataaatgattatgatgtagatgaaattaaatatgataaatttttaaaagactcaattaaagaggtagatttaaaaaatggcacacatacatgtaaaattggtaatgaagagatatttgttgaagatattgtaggaaagccaaagcttataatatgtggaggtggccatattgcactacctttaagcaaaatgggaaagatgcttgaatttcatgttactgtaattgataatagaatagaatttgccagcaaagaaagatttcctcatgttgataagattatatgcatggattttgatgaagcaattgaagaagctaaagtaaacggtaatacatacattgtaattgtaactagaggacataaagatgatagaaaatgtcttgaaaaagttattagaactgatcataaatatattggaatgattggaagcagaggtaaggttgcatctgtatttaacgctatgattaaagagggatacagagaagaagaattggaaaaagtatatagtccaataggtttgaaaataggtgcacagactccagaagaaatagctgtaagtatctttgcagaaataatagaagttaaaaataaaaagatggcctgtaatattgaagacagcataatagctaaattagattcttcatctgaaaatatggttcttgcaactattgtagaaaagagtggatcaacaccaaggggtgtaggggcaaaaatgttgattattgaagatggaagcgtaataggaactgttggtggcggtagtgtagaaaatgctgtttatgaaaaagccatagaacttataaaaatccagaaatgccacatagaaacatatgatttatctaattcaaaagcttctaaattaggaatggcatgtggtggaagtgtaaaggtgctatttgagtatataagttctaattcacagtcaacagatagtggacaatgaaaatcgtgagaaaagttgaatgtgtaatatatacactaggctataaattttacaattataatttagaatcatattgtaatttgaacattaattattaattgtcatatgtcaattgtaatatatattgcaattgataattaaggtgaaaatctttacagaatttttgaaattatatgcagaataattattgcaacatatatattttttaaaacataataaagaaagtgggaaaagtaatgagcaaaatgattgatgcaaaaggtaaaaactgtccaatgccagttataatggctaaaaaggaaatagatgcaggggcacaagaacttataattgaagttgataattcaattgcagttgaaaatcttaaaaagctagccaatagtcaaggattttttacaaatgtgaaagaggaaaatggaaatttttcagttgtatttaataaggactgtgaaaaatgtaatgaaatattatcacaattagataaaaaaacgtcagtaggaaattattctgtgtttgttggaaaagaaataataggctctggaagtgaagaacttggaaaaaatcttatgaaaatgtttttctatacattaagtgaaagtgatgatattccaaaatatttactttttatgaatgatggtgtaaaagtgcctacaaataatgaacaggctatagaacatttaaaggaacttgaaaatagaggtgttgaaatattagtgtgtggagcatgtcttaatttttataaccttgaagaaaaacttgaagttggtaagataagtaatatgtatgacataactaatgctatgaaagctactgataaggttattactttataattagcacaggattttataataatatatcaataaattattcattggcatataaattgtatttttgacttttaaatacaatttatatgctgttttttatgtgtataaaattaaattatttctatatacttcttgcatgtatccttagtttgacctattactttacaatatggagtaaattcattcattctagctacatacttcactgcatcttgttcaggcatagatagtagaagtccaccagatgtctgagggtcaagcaatacatctattgtttcttgttttatatgtgaggaatgagtaaagttatcttttaagtattcaagattattatacataccttctggaattattcccatggaagcataagttagagcatcacttattataggcacatctttagaaaataattcaattgttttattgcttcctttagccatttcatagctatgacctattagactgaatcctgtaatatctgtacatgaatttactttaaggccctttgtactttctttggcgtacttatttaaagtagtcattatgtcagaaacttccttgattttatcgtaagacagtaatcctgctttggatgctgtattcattattcctatacctaaaggttttgtaagaacaagaagatctccagtttttgaattactatttgttaagatatcatttggatgagcaaatccacttactgaaagtccgtatttgggcacagcatctgcaattgtatgtccgccagcaatcacagctccagcttctgaaactttattgtatcctccagcaagtatttcatgcattatttctggatcaaggcatgatggaaagcataaaagattcattgcaagtgttggtgtacctcccattgcatatatatcactgagagcattagctgctgcaatctgtccaaatgtaaatggatcatctaccattggagggaaaaaatctactgtttgaattatagcagtatcttcatttagtttatatacacatgcatcatcgctagtatcaaagcctactaaaagatttgaatcatgaaatttaggcagtgtttttaaagctttttctaaagtggctgcaccaatttttgcagcacatccagaagtctttgtaagttctgttaatttaattgtttttttcatttatattaactcctttaaaagttatgtgtactacgtttatcctagtatgtatattacactatgaattttataattagaatttgaaaataatatgaaaattttgtatatatatgttgcaataattattctgcatataatttcaaaaatcctgtaaggattttcactttaattgtcaattctcaactgtcaattttcaattgcaatatatatgaacattcggtcgatgttaaaaatgtacgttcgtatatatataatgtgaaataaatatatataatataattatatcatgtgaataaaattaaaacaaaaaatataaagaatatacaatataagaaaaaagtctacacaatttttaaaaagtgtgatacaataaattaagaaatacgtatgttttattgataaacattaaaaatattcggtaatagcgtttaggggacaacatgaaaaaaggaagtatttatcaattagaaggcagagtaccattaggacaggcggttccattaggaattcaacatgtattagcaatgtttttaggtaatgtttcaccacttatcattgtttgtggattattaaacattccacttgaaacaaaatcaatgcttatacaaaattctatgtttatagcaggtatagctacattaattcagttatatcctgtatttaaggttggtagtggtctaccagttgttatgggaacaagctcaggatttataggaactgaaaaagcaattggtgctgcttatggatacagcgcaataatgggagcatctttaataggagcaattttagaaattattttaggattttttattaaacctcttagaaaattatttccaccaatagttacaagtcttgtggtaatttctattggactatcattacttcctgttggagtaaaatactttgcaggtggagctggagcagcagattttggttctcctaaacatttattagttggaacagttgtaattttagtaataatagtattacagaattttactaaaggatttgttaaaacatcagcaatattaataggaataattattggatatatagtagcagtatgtatgggaatggttgattttacagcagttaaggaagcttcatggataagccttccaaggccttttgtaatgggatttgaatttagactagatgcaataatttcaatgagtataatgtatatagctactacagtagaaacaattggagatatatctgcaatttcagtaggaggacttggaagagaagctactgataaggaattagcaggcggtgttatggctgatggtgtatctagttttatagcagctttatttggagtagcacctaatacttcttttagtcagaatgtaggattggttgcagtaacaaaagtagtaaataaatttgtaataatgacaggagcagtatttttaatccttgctggatttttcccaaaacttagtgcattattatcggtaatgccacagtcagttttaggtggagctgcagttataatgtttgcaatgatatttgtaagtggtcttaaatcattgttgaatgaaggattagaaggaagaaacggattgatagttgcattagcaattggaattggagttggaattggtaatgttccagaagcattagatcaattaccaaaattcattggacaaatatttgctcaaaatggaataataatgacatttgttatagcttctgtgttaaacttagtattacctaaggacaaagatgaagctcaagaaatgtctgcacaagtataaattaattaaaaagaaatccactgcttatatagaaaaggtagtggatttttgtataatataagtatgaagtttaatagcaggaggagaagcatttgtttacaattaaaaattatgtggttgcagaaagtttagaacaagcttatgagcttaatcaaaagaaaaataatgttattttaggaggaacagcctggcttaagatgggtaatagaaatatacagacagccattgatttatctaatcttggtttagatacaatagaagaagatgatgaatcatttaaaattggatgtatgtgtacattaaggcagttagaagtagacaagaatttaaattcatactttgatggtgcaatagaaaaatcattaatacatattgttggagtacaatttagaaattgtgcaacaataggaggaagtgtttattcacgatttggattttcagatgttttaacatgtttgttagcgttagatacatatgttgaactatataagggaggaataattcctttagaagtttataaagatatggattatgatacagatgtcctagttagaataataataaaaaaagataaaagaagagtctcatacttaactatgcgtaatagtgcaactgatattccaacattagctattgctgtatctaagaaaaaccttacttggaatgttgtaataggtgcaagacctcaaagagctatattaatagatggaacagaatttttaagtgatattcctactgaagaagaaaaaaataatttaatatctcatatagtaaataatgttaaatttcaaagcaatatgagagctagtatggaatatagagttcttcttgcaaaaactttagtattaagagctattaatgaaacattatcttaattgataaatttatataatgaataaaaaagattacggaatgtgtaattttgaaaatatattttagactaaaattataaaaagtgtagactagtgtgggaggaaccaatggaaattaaattatggataaatgataaactatatatagataatattgaacctgatatgatgcttattgattttgtaagaagcaagggattttttagtgtgaaaagaggttgtgaaacagcaaactgtggactttgtacagttcatttagaaggaaaaccagttttatcgtgcagtactcttgcagcaaaagctaatggaaaacatgtaacaacacttgaaggactaaaagaagaagctgaagaatttggtgcttttatggcagatgaaggtgcagagcagtgtggattctgcagtccaggatttgttatgaatgttattgcaatgaaaaaagaattacataatccaagtgaagaagatataaagtactatttagcaggaaatttatgtagatgtactggctatatgagtcagcttagagcaattaaaaagtatcttaataaagttaaggaggactaaagatgaaattcgttaataagggaataagaaaaaaggatgctatggcattagttactggtaagcctgtttatactgatgatttagcaccagcttcatgtcttatagttaaagttcttagaagtcctcatgctcatgcattgattgaagaaattaatacgtctatagcaagcaaggttccaggaattgagtgtatattaacatatgaagatatgccaaagtcaagatttacaatggctggtcagtcttatccagaaccaagtccatatgacagacttattttggataaaagacttagatgtgttggagatcctgttgcaattgttgcaggtgaaaatgaaaaggctgtaaataaggcattaaatttaataaaggttaaatatgaagttttagaaccagtattagattttagaaaagctaaggataacaatattttagttcatccagaagaagattttaaggctttatgtgatgttggagcagataacaagagaaatctttgctcaactggtggttttgaacatggaaatgttgaagaagagtttaaaaaatgcgcacatgtaatagaagaaacttatcatacaaaggctaatagtcaggcaatgatggagacttttagaacatttactgaacttgatacatatggaagattaaatgttacaagtgcaacacagattccattccatgtaagacgtattttagcaaatgcattagaaataccaaaatcaaagataagggtaattaaacctagaattggtggaggttttggtgcaaagcaaagtgttgttgcagaagtattccctgctatagttactttaaagactggaaaacctgcaaaaatgttatttacaagagcagaaacacttactaatggaagtcctagacatgaaatggaaatcaaagtgcgtttaggtgctgatgaaaatggaataattcaggcaattcacatatatacattatccaatgcaggagcttatggagaacatggacctacaacagttgggttatctggacataagtcaatgcctttatatagtacaccaaaagcttataagtttgatttcgatgttgtatattcaaatacaatgggcggtggagcttatagaggatatggtgcgactcaaggaatatttgcacttgaatctgcagtaaatgaacttgctgcaaaattaaatattgaccctataaagcttagagaaatgaacatggttaaagaaggagatataatgcctgcttactatggagaaaaagctaacagctgtacacttgataaatgtctttcaagagctaaggaaatgatagactgggataataaatatccatgtagggatatgggtaatggaaaagtaaggtctgttggagttgcacttgcaatgcaggggtcaggtatttcaaatgttgatacagcagcagtagaaataaaattaaatgatgatggtttttatactttaatgattggtgcatcagatatgggaacagggtgtgatacaattcttgcacagatggcagctgactgcttagattgtgatgttgatgatataattgttcacggtgttgatacagatcaatctccatatgatacaggttcttatgcatcaagtaccacatatataactggtggtgctgttataaaaacatgcgaaacattaaaagaaaagattcttgatgaagcatcaaaacttcttgaatgtaaaagagaaaatcttgaattcgaaggtggaaaaatattctcattagaagatgataaagaaatcacgttaaaagattttgcaaatagaagttatattgctgggataaaaacaataagtgcaagtgaaactaattattcaccagtttctccacctccgtttatggtaggaatggttgaaactgaaatagatatgacaactggtcaggtagaaataattgactatgttgcagtagttgactgtggaacagtaataaatccaaaccttgcaagaattcagacagaaggtggaattgcacagggtattggaatggcattatatgaagatataacatataataaagctggtatgatgaggaataattcatttttacaatataagattccatcaagacttgatgttggaacaataagagttgaatttgaagccagctatgaaccaacaggaccatttggagcaaaatcaataggtgaaatagttataaatacaccttcaccagctcttgcgcatgctgtatataatgcaactaaagtaaatgtaagaactcttccaataacagctgaaaaaatagctatgggaatgatgaaaggtgaaaattaatcttattttactagcatcaggatttagcagaagattcaatggaaataaacttcttacagagttaaatgacaaacccttatatatgtacattgttgacacagttagggaaattatttctcataagcatttatcttcaacatatattaataaaataatatgtgtaactcaatatgaagagatagaagaaaatttaaaagatacaaatataaatgtgttgataaataacaatagtgatttaggagtttctaattctataaagataggaattagttatgatatgaatgctgatggatatatgttcatagtttgcgatcagcccttcataaaaaaagaaactttagagaagattttagaaacatttgaggaaactaataaaggaattgttgcacttggcatgaggaaacaagtagaaattcatgatatttgtaataaagacaatctagcagataagagttatgttataggaaatccagtgattttttctaagaattatatttctgaattgttatcacttaaaggtgatattggaggaaagagaattctaaaaaaacatattgaggatgttgaattagtatatgcagacaatgaaattgaattaatggatatagatacattagattcgtataaagaaataaaaaaagtattagagacatatgaaatatatggaaactaaatttcatataactttgaggggctttggttcattaattccaataaattaaatgaatttaataaaaggtagaaaacaattgagttagaataattgttttctacctttttcgtttttgtaaaggaaatcctatagagttgaaaatttatacacaagcaaaaactaaagcttttatttaaaactttaaactttcccctatgaattatcaactaaaaagcatggtgtagacacttatttaattataaagtatttacaaaaacaaaatatggtgataatatgtgtatatagagaatatacacacttagatacggaggtgtacaatttggatattttgataaacaatgattctcaagtaaaactatatgaacagattgaaacttccattaaaaataatatattaaatggaagtttaaatccaggagagatgttgccatctataagaatgcttgcaaaagaacttaaagtcagcataattacaactaaaagggcttatgaggagctagaaaagcaggggtttatagaaacagtagtaggaaagggaacctttgtttccaatgcaaattctgaaagactgaaagaagcagctatggcagaaatggagggacgtttagaagatgttattatttctgcaaaagcattaggacttacactggatgaatgtattgagatttttaaaaatttatatgaggaggtctagttttattatggaagcaatagaaataagaaatttgaaaaagatttataaggattttactttaaatatagacagattagatattaaatctggatttgttacagggtttataggacctaatggatcaggaaaaacaactacaatcaattccataatgggaatgcttaaagttgaccagggagaaattaaagtcttaggtaagaatattttagaagatgtaaaagttaaagaagatgtaggctatgtaggagatataccaggttttcttcaggaaagtagacttaaatatataaagaacagcatagcacctttttatcccaattgggatgaaaaaatgtacaaaagttatatggataagtttaacttagatgaaaacaaaatatttaaagaactatcaaagggtatgcagaagcaatttcagcttacaatggcattttcacatcatcctaaagttttaataatggatgaacctacagcaaatcttgatcctattgtacgaaatgaaattcttgaaataataagcgaacatatgttaagcgaagaaataagtacattttattcatcacatataacaactgatattgaaaagtgtgctgattatgttgtgtttatatataatggaaaagtttttcttcaaggtgaaaaggacgagattttagaaaatcatgttttagtcaaatttaaaaaggatttgtatgacaaggaaatagaaaatgagtttatatcaataagtaaaaatgaatttggatatgaaggacttatagatgacaaaagaaaagcctacgaactttttggggaggaagctatttatgaaaaatgttctttagatgatatattagtacattatgtaaagaagaataagaagtaataatctatagataacaaatttaatttgaatattaattattaactaaaagggaaagaaatattaatgatattagagagggaaagatatgaataatataaaaaatttattgaaactacattacagttcaatttttgcattaaagaaaacagcacttataatattggcacttgcagtatttatgacaatatcaaataatgatgggtcaatgcttccatttggagcagccttgttggttatggttttaaactacaattctttagcttatgaaagtaacagtaaatctgatttccttatttattcacttccagtaaagccaaaagagtatgttttatctaaatatatatttggatttattaacgtaataatttcaattatatttgctgatgttttatatatggtattaaatatgtttaactatatatcacaacaagatattccagttggaattataaatatagcagtaataatagtaggaatgattattgtagatatagttaatcccatagctattgttgtaggttttaataaagcaaggataatactaatatttttagctataatgccaatatgtttttcaagcacaattgtttttgcattatcaaaaattgatttctttaatattaatatatcaatgggaataatggaaacaatagttgcaattgtaggagtcattttaacaacagcatcatattttattactgcacatttatatgaaagaaaagatataaattaaaataatatacagagattttatataactattatttatactaacaatttataaatcttaattctatttactgcaattataaattacagtaaatagaatttattgtaataattatcaatttgtaattgaaggagaagggcatggtgtaacatttaaacaagaggaatggctaggacactgaggagttatttcgttgttattacatactactgaagaaccttggtttgttaatacagctaatttttcagatattgtagcatacatagttttatttataattaatcctaaatcagcagatgctaggaagtttgcataaagtgatgtatctggtgtagatgatgttgggctagtagttggatcatctttaacagaatagcttgaactcataggttttacacaatcaatagagaaacatatatcgaaattctcagttagttttaatttggtatttgtaggtaagcacattacttctgcaaaattgaaagaacttgggaaacctaaaccatttgatattggagttgcattttggaaaactgatacagctagtggtggatttgcgactaattcaggtgttgttgctccttttattactccagtgaatggctgattgcctattgtaccagatacattcatactcaaattgcaaatataaaatgatatatttctttcaactattttattttgagcataaggttgtgatgattgattacagcaacaagatgatgtttttacatttcctgaaaaatcagtatataaatttgttactggggtaccgcagctacattctagtgatattggagaaagtataaactgtttaccatcaatacttcctgtaattgtgtcggtggaatatggcgctactagtgaaggtccaactccaatacatgaatatgaataactaatattggtaatgcatatcttaccataaggtattgtggcagttgatcctgatgctggcgattttaataagttagtttctattactaaataattaggatatgcagcctcatatttatttgtacaaacacagttttgaattacatttgccaaaataggaactgatatttggttagatggatccccttggtttattattgagggagtgtcacaaggaatacagccacaatttattttgcttatttttgatgatacatcatttgaaaagcaattttgctgtgaagaagcagttgatttttcacaattagtcattaaattagcctccttgatatataaatttttatgtgattgtatatacaattattttatgattaatcaattagaaggttcattctattgattttattttgattatgaaaatttaataaatattctttaatatattaaaagattcttctcaattatcaaagtaaataatacttataaacatatgatatattacttagatatcttaaattaatcttaataatgtaataaatccgttgagatggtatgatttgttatgatataaataaaaagattataaaaataatattagatttaaagggagaatttttcaaatgaagaaaaaaatatcagcactacttttactttttttgttcttttcaatacttccaatgaagagttttgcggcaaatgttccaattaacccatgggattatgcacaaaagcttggaaaagggttagatgttgactggtcaaaaacaaaagaagggaaagaagcatacaactcacaaacagctaaagattttagtgacatgggaataaaacatgttagaataagaattaaagatgatatgactgatgaatcttttaaacttttggacaagcaaattaaggattgtcttgataataacataatacctattattgcatatcaggcagatgagttaaaaaatgatccatcagataagaatttaaagaaagtagttaaatggtggggaaaaactgcagagcattataaagattactcataccttttatcattcgatttaataattgaagttacagatgaattgaaaaaagagccagaacgattaaatgaaatatatgaagaaattgtaactgaagttagaaaaacaaattcaaaaagaattttaatgatatcacctagagttcgttctaatccagaatatttaaatgatttaaaaataccaacgaatcataatggatacttaatggctgagtggcatttttatgcttctggtccaagtaaaactaatagtgaaaaattatggacaactggtactgataaagaaaaacagataataatagataagataaatctagcactagattggcaaaagaaaacaggtattcctacatgggttggtgcatggatggctggtgattataatgatggaaataattattccgtacaagaacagattgtatttgcaaagtttgtatcagatgaattggacaaggctaatataccatttgcagtaaattcagatacaaagttttatgacaggcagaataatagatggtatgatgaaatgataccagtattaaaagctatgggatttacaaagaataatgtagattcagttatagataaaaaaacagaatgggttaaagataatataggatggtggctgaaaagagctgataattcttatccaaaattacagtgggaacttgttgatggaaactggtattggtttgataataatggatacatggcaacaggttggaaatatattaataataaatggtattacttaaataatgatggttccatgaaaactggatggttaaaagatactgatggaaagtggtattatttaaacactgacggttctatggctgtaaatactaatgttggtggatataatttaggatcaaatggagcatggatagaataataagtagatactttattaattaaatataaagcttttgtctaattatagatgaaggctttatatttatttgcagatgatatctatggatttaaggtatttgaaataaaatatataatatgctattttagatatgtaagtgaaaatatggagttgagattatgaaaaaagtgattatgaggaaaatagttaatggactcatttatatacatattcttcatcatgcagaaattgaacctatatatggagtatggatgcttcaagaacttgaacatcatggatatcatgtaagccctggaactttatatccaatcttaaaatctatggttgaagaaggtcttcttgaaaaagaagagagaaatgttggtgggaaaatacgtaaatactataaagctacagatgaaggtataaaaattcttaaagagttaaaggaaaacttaaaggaattaacaagagatgttacataagtaaaggaagtaaaatgatttttgttttgcttcctttactttttttattttatatgataatatcggattacgatatcagaattcgatattgaataaaaatgtttaatatgtaagaagaaaaaattaaagggagaattaaatgaacaacgctttagaaataaaaaatattcactataaaataggaaataagccaattttaaacggattatcactagaaattaaaaaaggagactgtatatctattgtggggccgtcaggaagtggaaagagtacattcttgaaattatgtgcagatcttattacgccatcacaaggagaaataaagtttaatggaaaaagttattgtacatataacccatgtgaacttagaaagaaaattagttactgtactcagactccatatctttttggtgatacagtaatggataatattgaatttccttataaaataaggggtgaagaactagataaaacaagaatagattatttattaaaaataacaggacttgatgaaagtattctttataaagatataaatcatctatctggtggtgaaaagcagaggattggaataataagaagtctcatatatataccagaagtacttttacttgatgaatctacaagtgcacttgatgaaaaaaatactgaaaatatagaaaaatttattaaaagtcttaatgaagaaggcgtaactgtactttggataactcatagtaatgaacagagtcaatccatatttaataagagaatagaaatatctaatggaaaaatagaaaaagttgaggtaatagcttaatgaatacacaatcacttattttatcatcagttttaattggaataccagtttttatatcatataaagaaaaattatctatggaaaaggacatacttataagcatagttagagctataatacagcttgttatagctggatatctccttgagtttttcttcgaagtagataataagtttataacagtaattcttcttcttataatgattataaatgcatcatataacgcaggaaaaaagtttggaaagttaaagaaagcagtatttatttcttgtatagccatgattataggtactggtgtaacattaagtgtattaatattatcaggttctttagaatttaaaccacaagatattattcctactggaggaatgatagtaagcaactcaatggtggctataggacttgcttatagaaatcttaataatgagtttaatgataaaaaaatggaagtagagattaaattagctttaggtgcagatattagagaagcttctcatgatatattaaaagaaagcataaaaacaggtcttgttccagtaatagattcagcaaaaactttaggtattgtatctttaccaggaatgatgacaggactgattctaggtggagcatctccaactgttgctataaagtatcagataatggttaccttcatgatattatcatcagcagcaatatcaacattaatatgtgtttatatgggttataaaagcttttttaacaaaagaatgcaaattaatctaatattgtagaacagtgtgctataatattctttgataaaaaatttatatagatatatatttaaagaattattataaaaatttatattatttttttatggaaaataaatattagaggtgaaaaatgaaactaaaaaaatacgtaggggataaaagtttttataaaatggttttaacaattgcaatccctatcatgattcaaaatggaataacaaacttcgtaagcatgcttgataatattatggtaggtcagataggaacagatgctatgagcggagttgctatagcaaatcagtttatatttatatttagtcttttcatatttggtgccatatcaggcccggggatttttagtgcacagttttatggaaatgataatcatgaaggtgtaaggcagacatttagatttaaacttatattatgtggaataattagtgttatcggtatatttataatgggtacatttaggcatgaactaatttcactttttcttcatgagggaagtgtaacaggaaatatttctgaaacattgaaatacggaagcggatatatagcaattgatataataggtcttataccttttgctataatgcaatgctactcaagtacacttagggaaacaggagaaactattgtaccaatgaaagcaggtattgtagctgtagcagtaaatcttgtattcaattatcttttgatttttggtaagttaggatttccaatgcttggtgcatatggtgctgctattgcaacagttatttcaagatttattgaatgttttatagttgtaatatggactcatagacacaaagaaagaaataaatttatcgtaggagcatatcgtaattttaaaattgaaaaaaatcttacaaaacatattatattaaggggaactcctcttttaatgaatgaaggactatgggcaatgggaatgtcagcattaaatgctatatattctcgtggaggccttgctgtagttgcaggactcaatatttctaatacagtatccaatgtgtttaatattgtatatatagcccttggaagttcagtttcgattattgtaggtcagcttcttggagcaggaaagatggaagaagccaaagatactgacacaaaacttatagtattttcagttgtaagctgtataggatttggattatttatgtcattaatttcgccattcttccctaaaatatataatacaactgatgaagtaaggcattatgcatcatattttatactaataatagcaatgtgtatgccacttgaagcatttatgaatgcatcatattttactcttcgttcaggtggaaagacttttataacttttctttttgatagtgtttcaatatgggtaatatcaattccatttgcttacattctcatgaactttacatcaattggaatagtaacaatatatttattatgccagcttataagtataataaaatgcataataggttatgtacttgttaaaaaaggagtatggataaataatatagttgtttaaaagaaagtaataataaggctctcagtttaatttgctgagagcttttatatttaaatgacaattaaataaatattattaagtcttgttcataaacacatttttgtattatatacatagattatatgtagtctaaagctaaatttacagattgacattgataaaagtatattttacaattagtaacgtaaaaatgaaaaaaaaggaagcgaaattaatatgctaagtgttattaaaactgcaattataacaatcataatatcatttatatcaggagtattactagataattacaaaaatttagcacctaaaatatcatgtactatgggaaaatgtgtacctataaaaatgaacaataaaaaaataagagcatatattcttaaagtaaaaaacatatcaaataagactcttcatgacttaactgttaatgtacaaggacaccacaatgatttaaaaatggacgatgcccaaataacaggaggattaaaatttgatatatgtggtgaatataataattttaatgtaagtataccttttttgagcaaaaatgatgagttttcagttaaagtatttgtggatgatgtacaaggagaacatagcaagccagttataactttacgatcaccagagaattttaaaaagataggccatggagaaaacaatggggtttttactgtattatcaggaacttcacaaaaaatatgtaacttattttcaaataaagaagagaagaatagaagaaatattcagaagaataaaatagaaaagagtattttgaataagaagactttaattactacagcatctataatttcattattatgtattgtctttttgggaaaaggactttataaaagtatatctggaatagcacaggatgagagtattcaaagtgatactgagcagaaatcaaattctatagatacctcatcaaatgaaaagactaaaaattcaagtagcaatacatctaataatggaaaaaatcaaagctcaagtacaaaatcatcttcaaaagatggtagcagtaatgaagtaaagggacaagattcttcatcatatgatagtggaaaatcatctgataataaagctaatgcaaattcagaagaaaataaaagtacatcagcatcaaatacagatgcaaataaagaaacagtaaatgaaaaaaatcaggatagttcatcatctactgcaaataataatacaaacaaacagtcagcagatgagaaagcaaatcaaaggacaaagactagtacgccaacaaatactgctggtaatacaaaagcaaatcagtcaagcacttcatcatcaagtgatacaaatgtaaattctgcaagtgaaaaacagcaggtatcaaatagtgaatcaagtgaaaattagtagctacaattttttataatagacagcaagaaaatcatataagaagatgatttttctgctgtttttttaatttgtataattattagaattgaattttgtgagggatatgtagtaacaataaagttttactaaagaaataaactcagatataataaacatatctgttccaattaacaattggaattatatatttttgaattaattttagaaatcatataaatttattagttattatagtagaggtacaaatgacgcagactgaaataaaaataggtagaaaaaaagtaagaattaatataaagaccatagatgaacttgaaaaggcgatgaaaaatgagggttatgatgtagctagttttgaaaatttaaatattgaggaatttaaaagtgaaatttgtaatttattcaatataaaacccagtgttgcagaacatatttattctaatatgagtcagtgtgaaagagagattaattataggtctaataatgttcaagattttcttgattatatggaaaagattacagaaatcaaggaatatgaaaaaatactttggaagaaaatttgtaaagtagataaaatccatatagataggattgaatatgatagaaaaccatcaattcaagaagatgtagagcatatgcttaatgcaattaaaaatgttaagaatactatgtgtggaaaaatagatgaatatgagaaattgagattatatgaattggagacaggaattgatgaaaactatatctatgctaaagatattgaattactaaaaaaaatgattattaaagataaaggtaaagttaagaatacatatgatgaatttacatgtaacaagagaatttacatagatataccggaaaatatgaatagtagttatataaagccattagaaggatctattgaatatcatgaacatatatcaagaaatataccacgtataaagcgtctaataaaaaatcttgataaatatatgaaaataaccagtgatgaagaaggaaatacagtttgtgagattaaccaaagcaaagctcttcaggattctataaatatagctgtggcagtctataatcaaaaggaatttaaagctgtaagcggaagtgatgaagtagatgattactgcgtggcaatggaaaaagaagaaacagtatttgaaagctgcagggttaatagacttgggaagattggaattggttataatagattttatgatagtgaaaagaaaatattagaggaaatccataaacagattgaagaaaagaaacttgatgatagaggtaatcttgttatgtatagcagatgggagccatgtcccagctgctattatgtaataagtcagttttgtagtgctcatccccaaatagaagtttcagtgaaatttgataaatcatatggggagtaaggattataagtcatctacatcctgttcttcgccatatcttacagttcctttagcactgaaactatcttttggatcataagatatgaaagtcccatcatttggttctttagattttgtagcacattttgtacatgattttgtctggacattggttaaatcttggatacttttcattttgctcatattaaggccttctttcttaatactattaatatagttttctatgataaaactatattaatagtatctgtaaaaatgcaaaaaaatctacaaaatgagtagtggaaatttttatgaagagtgactattaagtgataaaatattagaattcataaaatagaataatatttaaaagactaattttgatacattgttgcaaaagtattcatggattatatagccaaactgatgtttgtatagtataatttctataatttagattgatatttggtgtatatttagagggagttcatgtttggatatggtaaagttaatatttttgcaaatgaggggtaaaatgagaagtaagagagtaatagttttaatgggtatgatacttattatagtattaacagtagttgtatatggtattaatcaaaaagataataataattatatttcattaataaatcatataaaatattcttataaaaatggtaccataataaatttagataatttaaacttaaaaaaagaaattactatagataatagttcaaattttactttaccagaagaataccttgcattgggatataatcttatttatgataaagacaaaagagggatagattatcttaataaggcatttgatttaatggataaaaaaacagatttttatgtaaaatacttaaccatacaattgcttagaaataatttagcagatcttaatgaagaatccagatacattttagagggaataaaaaagtttgatgaaaaagaccatgagctccactttttagaaataagagaattattagtagaaggtccagatacagatgaaggaagaaaagttttaatcgattcaattaattatattttaaataataaaaaagtatcatcagaagcagctatatcatcatacagaaatatattggggatgcactatataatgcaaggaaagtattctgaaggcattgaaaattatttagaaataatttatttgggtaatagtatggatgataaatattatatgaataaggcgttaattgatttaggaactgtttatggtatgttaaatcaatatgaagaggctgaagaaatatatgaacaagcatatgatattaatctgcctaatatggaagatgataattatatgaaattatattattatgccaatataatagaatgtctaataaatcaaagaaagtatgatgaattttttgataagtgtgatgaaatggatagatttattgaaaaagaatataaagacggttataggaatcaatcttttatattacaacttaacatttataaattaaaagcatatttagaacttggcgaagtagataaggctgatgatataataaatacatttgatgatttagagagtcaaatgatggagaattattttattgattcagatatggcttattttgtaatactaggagattattactataaaaaaggtgactacaagaaagctatacaactatataaacgtgtgtatgattgtgaaaagactagaatgaataaaaatgcaaaagaagaggttttgcataagcttgtgtggtattatcaaagtactggagattacaaaaagtctagcttttattcaaatcagcttatagaattcaatcgtgatgaatcatcttttataaattcaggatatataaaatatataattgataaatatgaatacgaaaaagaattgatattagcatcagaagaactgcttaagaatagtatggaaagaggtatattagcagttgtttttatttcatctataagtgtaggtattattgttatttttatgttgaagaaaaataacagaattgatggtcttacacatatgtataatagaaaatattttgataaagaatttgatggtgtgttaaaaaaacagtataaaaactttatacacgacaagccatcatatttgtgtatgtatgatatagataattttaagaatattaatgatacttatggacatgattttggggatgaagtaattaaagctatagctgcagtatctaaaaaagaaattaaacataaaggtaaagcatttagatatggtggagaagaattcatactaattataaaaaatataaatgaggaagaagtgttacagatagctgagaatataagacaagctgtagaaaatctaagctttagaaatcaatataaggttactataagtattggtttaactgttgtagaagagaataaagaagtgacatttaaaaaagttgatgaaaaattatacatatcaaaaaaaactggaaaaaatagaattacatcataggtttattgtatcatctagaactataatttcccttgaaaaagaaaagtataatccatctattatgctttcttatagattagctctaatttttgatataactgttgaagaattattttatctaaaagaaaataaagaattggaggatgggaaatatgagaatttacaataaaaaaggcttcgttagtggaataataactttattattatgtgtagtgggagttattacagtaattttaaagggtccatctataaagttggttattttacttccatttctattgttattttcgttgacggaaataaggaggagtctttcgaaatctatgtctaaagaagatattattaaaaataatgacgagagagataagtatatcttattgaaaacatcttataaatcattagaaattctaagaagcataaattttatagtgataatgttatcaatgattttatttgcagttacaaaaagtgaatttgtacttggcatttttgtagtatcatctatttatatgacattgaattttctagtggagttggctgtaaatatttattatgaaaaaaatgaataagtgtattattgtaaagcagcttgatatttcattaatttaataaataatattaagtatgcattaaattaatgaaatagtttcaagattattacttatttaaataaccatatgagcatgaacatatttaaagttaaaatagaatatgaaatacaagctgcaaatcttgaattatttgttaaaatcaataaagctatcaaaattataaacagtatataccaatacttgtttttctttaactgcttttcttttaatcttttctgttgcgctttaactgtttttataaaagatatatcaatccaattatatataagataatatacagcagtagctactatacataaaaagctttttataacaatatcattaaattcagcagctaatcctacaataatatatatacccacaacaaataatatatattttatatactctatagtctgtagtaagaaattaattatatcatcattattatttttttcctcataaaacttatccttaaaatattaaatttatttagtgtcttatattatagtctaccacataattaggagtaggaaaataataaagacatgcctcgatgattctataatagaatattgtattgttacaagtattaaataacggattactagtacagatgatgattaatcaaaagagttgactctatttacaagtaaactggaattttgttgaaatttattactttacaaaatagtagatgtagcgtaaaatataataaacatatgttcgcattgggatgagtttaattgtataaagcagggggagaggataaatatgaaaacaatagaaagaacagatgaattgcaattaataaatgctgtagaacaatatttaaaattaacatgctatgagtcatacataggaaatgatttagaaacagtatttaaacatgccagaaaaaatggagattacagatttaagatgttaaatataatagaaaagtttatattagaatagataaacttttttattactgcctatgttttaatatagcctgcaatgcaccataactatttcattaattttaagaaattgttaaaattagcatttaaagtaagagagatttttaatagattctataatatggtaaaattaattggaagtatactattagattaaaggatatggtgctaaatatggatatgagtattatgaacatattaattgttaaagatgatattgaaataaacaatttaatatcagaagcattgaagaaggaaaattataatatagtacaagtatataatggcaaggaagcagtggagaaatataataaaaaacttgcagagagtgttgatgggattatcagtgttgaaagtattccatatgaaagaacttcatttatattaaggttaagaaatatgtaagaaaatattaaattttgtgtgaagactgtgatgtatagtgaaatcatggtcttttttaattattattttgggagggaaaatttgtggaggatattttaaaaacttatgatctgacaaaagaatttaagaagttttgtgcagtgaagaatttaaatatgaatataaaacgaggagatatttatgggtttctaggtgaaaatggagcagggaaaactacaacaataagaatgataatgggacttgttaagagcacctcaggaagagttgaactgttttcaaaagaatattcagaatctgacaggaaaattttaaataggatcggaagtatgattgaatatcctggattttatccaaatcttactgcatatgaaaatttagagatacacagaagaatgattggatatccagataaaagcagtgtaattaattcattaaaaacaacaggaatagaagatgtgaaaaataaaaaagtaaaggaattttctcttggaatgaagcagagacttggaatatcaagagcagttctgcatcatccagaatttcttatacttgatgaacctacaaatggtcttgatccaaggggaataaaggaaataagggaaatgatagttgaccttaataaaaaacagggaattacatttcttatatcaacacacattttgagtgaaattcagcagattgcaactaaagtaggaataattaataaaggaagtcttcttgaagaaataaattatgatgagatcaagaaaagaaatagacaatatataagaataaaagttgatgatgatagaaaggccattgtaaatcttgaggaaaaatttaaaataacagattatgaagtaattgaaaaaaatcatataagaatttatgaaaaattagatcaaatttcccacataaacaaaatgcttgtttcaaataatatagaagtttttgagatgtgtataaacagggataatttagaggattactttttaaatcttataagcagagataaaagtagaggatttaatatttcaaaggaggaaatataggtgatatgaaaaatatactgtatgcagaatttatgaagctgaaaaggtcatacataatacctgcagttttagtttctgctatttttattcctattgtaatgtttataaatttaaaacagcctaaagaaatattaaatcaggatttttacatgaatacactgcttaatattgatatgttccaaattgcggtatttaacaatattatgacagcattagttattggatatatattttcaagggagtatacagataaaagtgctaatgttacatattcatatggatattccaggtttaaaatagatgcaggtaaatttatagtttcagttatacttattattgttgaacagattataaatttagcagtaatatcattactttttatatttaaaggatataccataccaggggatgttttgatattacagtgtaaagttgtagctatatcatctattataagtataatgatgatgccaataccagctcttataggaatttggagcaagaatataatagtacctgtaatatatggagttattcaggccgtatttgctattttcataggttcattaggtggaatttatgtacagatttttcctatgtcattgtcagtggttccgatatattactattttgttaaagacctaattgattatgtggcattaattatatcaatatcgttaattgtaattttttcaatatcagcttttatggtttatataaaaaaggctgatataaattaggaggtatatgagatgatatctttaatatattcagaatttctaaaattgaaaagatcaagtattatattttttatagcagtaggttcgtcttttatgccactattgcttgatgctgcaatattaatgtcaaatgataggcatagaacatatgaaagttatatgtacaattctgaaggtataagttttacttttatgcatggaatattattttctataatagcagcatatattttttcaagagaatttaattataaaacatcaggaaatttgtattcatattcatatacaagaaatcagattttcagtggaaaacttatagtggtatggattataatgatcataattaccattatgcagtggatggtttctaatttagggtattgcatattatttggagtaccagaatggaatcttattttaatagatatgctaataaatataaaagccttgctgtttcaaatagctttagtttcaattccagttcttattgttaatataacaaataatattattatgccagtaatgtattctgtagttatgttgatttttcaacttataacatctgaaagaaattttaaatttaacgtaataaatccattgcttggctctacaagtttatttgcagaagtatatggagaaaaaagctgtgatataaagtacatggctatatatgcggcacttatatttcttatatttacaacagcaggattttattatcataaaaaaatggatataaattagaattaacaaagagggcagatattatgaaaagatatataactatatgcatattcatgtttttaatcctgttaagtattgctatatctggatgtagaacacagtatttaggcgggaacagggacgaaaagtggacaaaagatttagaatatcttagaaaagcacttccaagaaagagtgtagattcatttttcaatataagtgaaggtgaatttaatgatgaaatagatgatttggaagaaaagatatgtgatttaaatgatgaagagattatagatgggatttataaaataacagcaagtattggtgatgctcatactaatgcttatgcacgttataacggaagatttccagtacaattttattactttggtaatgatatatatttaattaatacgactgagaagtatgaccaagtattaaattataaattgaaaaaaataaatggaatggaaatagaacatgttgaaaatctattgaaaccattaataccacatgagaatgaagctaatataaagaaacatctgccaacatttctatcaaggccagatatattgaaggggtaagcataacagatagtttagataaggttgattttgaacttgaagatagtaatggaaatgaacataatattgaaatagaagcagttaatgatgataatgatttaaattggattgttgaaaagaatgattcatcatatcccttgtacagacagaatagtgatttgaattattggtataaatatttggaagaggcgaaagcagtttattttaaatataattcatgtattgaagatgaggatatagggaccatcaaggatatgacagatgaaatttttaatcttattgatagtggaaaagctgacaagcttattatagatgttagaaataattctggcggcagtgatggatatttaaatgaattgatagaaggtattaaggctaggaatattaataatccagataagctttttgttattataggaagagagacattttcatcagcaataatagaagcagcaagacttgatgaagaaacaaatgcaacattagttggagaaatgaccagtggaaaacctaatcattatggatctgtaggaaattttaaacttccaaattctaaaatttcaataaggtattctactaagtatataaatatttttaagaatcagggaaatagtttaatgcctgatgttttaaaagaagtatctattgatgattatataaataagaaggatcctgcactagattatatattgaaaaattcataggagaagaattcggagtataataaaacgattatgtgataagaatttagagtatgatataatgaaaataataatttatgaaaaattatatatttattaaataaaaagatatcaacaaaaggaaaatatatttgtataacaagaccaagaagatttgggaaatcaagtgtagcagatttgtttggagcatattactcaaaggcagttgattcaaaagaattattttataaattaaatataagctcatgtgatggatatgaagaaaacttaaataaatacaatgttataaatatttcatttaatgaaattcctgatgaaatggatacgtatgaagattatatttctaatatccaaaaggatttatcaagagaaattaagaaaccttctaaaagatcagccttatgtggcattagcatatatgacaggagttcttccaataaagaaatattcaagtggatcagctcttaatatgtttgacgaatttacatttttaaaagacagacagtatgcagaatactttggttttactgatgaagaagttatacatttatgtaagcagaataataagattgattataaaaacttagaaagttggtataatggatatcttacagcagaaggaataaaggtttataatccaaggtcagtagtaaaagcactttctaataatcattgtgaaagttattggactaatactggggcaatggatgaagttgcagaatatctaaagtataacattcatgatatcagagaagatgttatagaaatggttgctggaaatgaaattgatattataattgatgaagaattcagggcagggcagagagcaccgagaactaaggaagaaatatattcggcaatgatagttcttggatttttatcatattatgatggctatttaagaattcctaataaagagcttatgaaggaatttgaaaaggctttaaaggatgaatgttttggatatgtttctgaaatagttgaaaattcaaagaagatgattaaagcaacaattaatggagatactgaagtaatggcagaaatacttcatgatgttcataattcagaaattccaattcttcagtataatgacgagaatagtttagcatgtgttgtcactttagcgtatctttgtgcaagggatacctataggattgagcgtgaagaaaaaagcgggaaaggttttgtagacttcgcatttcatccaagaagaaaaaatgatacggcatttattttagaacttaaaaaagatgatacctcagaaaatgcaataaagcagataaaaaataaagaatatgcacagaagtttataaaagaaaatgaagatagaaagatggttatagcagcaatatgttatgattctaaagaaaaagaacatcattgtttggtggaagaaatataataataaaatataaaagctcaatgccagataattaataggcattgagcttttttacctttaacatattttactaaaatatgttataattggatcatattatatgatgaataagtatatttggaggaagaaatgaaggtattagtattttgcgcaaagggatttgaaacaatggaatttagtgtctttatagatgtatttggatgggcacgaaatgactacaattatgatattaaagttgaaacatgtggatttacaaaacaagtggtaagtacatttaatgtacctattacagtagatagaattatagatgaaattaatgttgatgaatatgatgcattagcaattccaggtggatttgaggaatttggtttttatgaagaagcttatgatgaaaaatttcttgggttaattagaaactttgataaatgcggaaaagttattgcatctatctgtgtaggtgctcttccaattggtaaaagtggaatactaaaaaataggatgggaacaacttatcacttgcgtgatggatataggcagaaagaattagcaaaatttgatgttaatgttgttaatgagccaattgtagttgataagaatataattacatcttattgtccatctactgcttcgggagttgcatttatattattagaaaaattaacttcaaaaaaagaaatggaagttgtaaaggaagcaatggggttttaagatgaatgaagttttaaatttattagaaaatttacatataaaatatgatatagtacatcatagggcagtttatactgtagaagaagcagaaagtatcaaaattaatcttgatggaattgggtgtaagaatttatttttaaaagataagaactattactacttgtatattttaaaagaggataaaagagctgatttaaaggaaataagtagtaaattaaatataaaaagattaaccttttcaagtgaagaagaattatgggataagttaaagctaaaaaagggatctgtaactcctatgggaataattaatgatgataaatcagttattttaataatagataaagatttgaaagataaaaatgtacttgtacatcctaatatcaatacagcgactatttgtataagttatgataatttaataaaatatattgagtattttaataatagctactatgaaatttaagatatctttaaatataaaagctcaatgccagactattaataggcattgagctttttggttatcataaattttgattatgtgtggaattataagaattagggaaaattggtgggctaagtttaaacttaaaagtgtctctatcaattaatccaacaatgctcttactagtgtataaatcaaataaaaattctgccatttctctgcttgtatggtaattaccaaaacttttatcataatcataatttgaaatattatttgctacatttccaaagtttgttttagttgcagcaggtgcaagcacttttgcttgaagttttgcattactgcttataagttcatgggataatccttcagtaaatgcacttacaaaaaatttactcgcacaatatgtgactgcatttggtacaagtgtatatcctccggcagaagaaatatttataagagttgtaccttcaacgtctttataatcatgaacaaataatgaggataaaatagtaacagctttaacattaagatcaagcattgtttcaattttatttaaattttgagtcactacattatcataattaccaaatccagcattattaattaatgtttcaatattataatctttcaaactgttataaagttcatagacattttttacaactgataaatcagtatttttaattataatgtccaaggaaggattctccttcaaaatttcagtctttaattctattaaattgttttttgtacgagctacgattattaaatttttccctttagatgcaaaaagttttgcactctcatatccaattcctgagcttgcccctgtaataagtgtatatttatttttttctttcataataatacctcctaaaatatgctatacttggattatattatctagagtcaactagaggtcaagcatatttggaggaattttattatatggattattcaattggagaattttctaaaattacagaaataagtatatatacattacgctattatgagagtgagcatttaataacaccagatagaaaaagtaatggaagacgtgtatacaaagagaaagatataatatggatacaatttataaaaagattgaaagataccggaatgcctattaaagaaataaagaagtacgctgaattacgctcagatggggagtctaccatgacagaaagaatggttatgcttacacagcataagaataagcttgaagaagaaatagagacacttaatgaacatttggaaaaattaaatgagaagattacatattatgagggagaaattaaaaataaagtgtaatttagtgataatggttaggataatttaaaaggagaagaaaaatgtttgaattagcagtgaataaattaaaaaaatatctggattcgactcaggtttttgaagatgtaagttttaaaatatactcaggagaaaaagttgggatagtaggagataatggtacaggaaaaagcacgttattaaagttgattgcaggaattatacaattgacaagagatgataagggggacatctttattccaagggatgcaaaaataagttatcttgaacagattcctgattatcctggcgccttaaaggcagcagatatattaaatatggcatttgatgaagtaaagaaaattgagagtgagataaaagaattagaagaaaagatgagctcactagatggaatggagttagaaagagcattaaaaaaatacagtaaccttcaggaaagctatgattcaaagggcggatatgagcagaaggaaaaactaagtaggatatgcactggtctgaagataactgaggcattcttagaaagcagcttcagagaattaagtggtggagaaaagactactttaatgcttggaaaaatactgctggaaaatccagatatactgcttcttgatgaaccgactaaccatcttgatatggaatcatgtgaatggcttgaaggatttctaagaggttataaaggcatgattattattgtatctcatgacagatatttcttagataatgtggttacaagaattatagaaattgaagatatgatgtgtgaaagctataatgggaattattcttcattcactaaacagaaagaagaaaatatgatgattcaattcaatcaatataaagaacagcagaaaaaaattgcagctatggagaaagcaataaaaaaattaagggactgggcttccagaggagataatgaaaaattctttaaaagagctgcaagcatgcagaaagcactagataaagtccaaaggttggaaaagccgaaatttgataaaacgaccgtaagactggatttcaatgaaactgaaagatctggaaatgaagttattaaggtaaaagggttaagcaaaaaatacaataataaagttttgtttgataatgcagacttgatggtacgttataaggacagggtgggtattattggatcaaatggatgtggaaaaactacttttttaaggattcttcttggtgaagaagtaaaagacagcggaaatcttatcattggggatagtgtaaaatatgcatacctgcctcaaaatattgtatttgataatgaagaaatgacaatcttagatgagtttaggaataatgtattaatgcttgaaggtaaggcaagagaatatttagcgaaatttatgttctttggaagtgatgtattcaagaagattaagaatctgtctggaggagaacgaataagagtgaaattaagtgaactgctttactatgatataaatttattaattcttgatgagcctacaaatcaccttgacataaattcaatagatactctggaagaagctttaggagattttaagggaacaatcttatttatttcccatgatagatattttcttaataaaatgagcaatagaataatagaagttaaagacaagaaatttaagatctatgaaggaaactatgattattacaaaaatgaaaaagttaaactagaatctgttaaagaaaaaattcaagtagttcctgaaaaagaagtttcaaatgaatggatagagaaaaaagaagaacagaagaagaaacgcttgagtgaaagcagagtaaagaaactagaggaaaaaatattcagcttagaggaaaagcttcaagagattgacaggaaaatgattgaggcaggagcggattatgaaaaagccaataagctttgtattcataaggaagaaatagaaagagaattggaacagattatgaaagaatgggaagatatttgttaatgttaaattatagctattataataatatatgttataattggacaatatgaattgttaataagtggaatgtgtaatgaaataagtggggcataaggatgaataacataggtacaaaaacaatagagacagaacagttaatattacgaagatttgaatatgatgatacaaagagtgttttaaagaactgggcttctgatgaagaagttcagtcattatattcagaaccagtatataaaactgaaggagaagtaaaggaattactgaagaaatacatagattgttataaaagtgagacttattatcgatgggcaatatgtttgaaggatagcaatgaatgcataggacagattgcgtattttatggttaatgaacagaatcattttgcagaaattgaatattgtattggacgcttttatcaaggtaagggatatgcgacagaagcagctaaagctattataggggttggatttaatgaaatggatcttcataaggtacagatatgccataaagctttgaatgaaaaatctaaaagggtaattgaaaaatgcggattaaagtatgaaggaactttaagggatttcttttatgtagaaagtgaaaataagtatattgatagattatattattctattttaagagaagagtatgatttaatgtaacgggaatcaaagttaataaatatattgtacaaatttaatatatctttaaaaatgttgttaatgagccaattgttattgataagaatgtaattacatcttattgtccatctactgcctctggagttgcatttgcattattagaaaaattaacttataaaaaagaaatggaagttgtaaaggaagcaatgggtttttaataataagatatattgaatattttaataataggtattatgaagtgtaagtatcactaatgaaaatataataggagactaagtatatcagattatttgaatggatatggtgtaaaaataataaaaaataataactggaggtaagaaaatgtttgaatctagatgcggtgtatgttgtaatagttgcgaaagaagagaaaaggtaaattgtaatggttgtgttaatatggaaaaaccattctggggcggagaatgtggtgtaaaaaaatgctgtgaagaaagagaattaaatcattgtggcaagtgttcacaatttccttgcaatatgctctcttccatgggtgttgaagaaggctttgatccaaaacctaagataaatcaatgcagaaaatgggcagaagaaaattaaatgaagtagttattaaatattgaggttgagtaagtaaattatgataaagacattgatattagcactaatatacaatattaatattatgtattaacaggtagtctaattttaagttgaaattggactacctattttagagtatatatatcaacaatttagaccaacagaatcttattttaaaaattatcttgactattttctaagaacggaataatatagttttataatttgatagttatcgaagtataataaaatgattatgtgataagaatttaaagtatgatataatgtaaccaataatttatgaaaaaatgatatatcaatacaggaaggagctgaaaattataaatatttatttaaatactgataagtcatatataaactttaataagcttgtaaatacaccatattttgtagataaaagcttaattataaataaattaaatcaaataatagacacaacaaattgttatgtctgcataacaagaccaagaagatttggaaaatcaagtgtagcggatatgcttggagcctattattcaaaggaagttcattcaaaagaattatttgataaattaaatataagcagatgtgatggatatgaagaaaacttaaataaatacaatgttataaatatttcatttaatgaaattcctgatcatatgaatacatatgaagattatattggtatggtgaagaattcaataaaaaaggatatttcagataattacccagagatagatataggtgatttctataatattagtactgttcttagagcaactaatgaaagatttatatttatatttgatgaatgggattatatttttaacaataatctgtttgaggaacatcaaaatgattttctagaatttttgagaaacttactaaaagatcagccttatgtagcattagcatatatgacaggagttcttccaataaaaaaatattcaagtggatcagctcttaatatgtttgatgagtttacatttttaaaagacagacagtatgcagagttttttggatttactgaggacgaagttatagatatatgtaagcaaaataaaaaaattgattataaaaacttagaaagttggtataatggatatcttacagcagaagggacaaaggtttataatccaaggtcagtagtaaaagctctttccaataatcattgtgaaagttattggactaatactggggcaatggatgaagtagctgagtatttaaagtataacattcatgatatcagagaagatgttatagaaatggttgctggaaatgaaattgatattataattgatgaagaattcagagccgggcaaagagcaccacgaactaaggaagaaatatattcggcaatgatagttcttggatttttatcatattatgatggatacttaagaatacctaataaagaacttatgaaagagtttgaaaaggctttaaaggatgagtcctttggatatgtttcagagatagttgaaaattcaaagaagatgcttaaagctacagttaatggagatattgaaataatggcagaaatacttcatgatgttcataattcagaaattcctatattgcagtataatgacgagaatagtctggcatgtgttgtaacactggcatatctttcagcaagggacacttatagaatagaacgtgaagaaaagagcggaaaaggttttgtagacttcgcatttcatccaagaagaaaaaatgatacagcatttattttagaattaaaaaaagatgatactccagaaaatgcaataaagcagataaaaaataaagaatatgcacagaagtttataaaagaaaatgaagatagaaagatggttatagcagcaatatgctatgattctaaagaaaaagaacatcattgtttggtggaggaaatatgaattcaaaagaactagcgaaaatatttaaagcactatctaatgaaaatagattagagatatatatggagatattaagatgtacagaaaaatcatatgaagatgataattgttgtgagtgttttcttacagatataataagcaagtttaatataggagcacccactatatctcatcatttgaaagaacttacaaatgccgggttgatttttactgagaaaaagggcaagtttgtaattgcaaaaattaataaagatttagtagatgaagcatgtgacatgcttaaattagatagcaataaataaatgacttattatagtcatttatggctgtataattcgatagttgtcaaaatatagaattgatatatttgtgaagagaatataaaaataaaactcataatcaaaattataattttggttacaagaaaggtgaaagatatgaagattttttattttacagcaacaggcaacagtttatatgtagcaaaaagaataaaggagaaaattaatgattgtgaacttgtttgtatacctaaaataagtgaacaagaggaaatggtattagatgatgatgttataggttttgtttatccaataacaatgtatgattttttatctaaattgaaaataaagagtgagtcatatgtttttgcagtaggtgtttcaggaggaggatcttctaatacaagtttttatcagattaataaacttattggaagaaatattgataactgtctttcgattaaatatacttctaattatttgaaattagggacaaacccgtcagagaaaaatttaaaagatgcaatagcaaaatatgatgataaaatagaagaatttatagaggttataggaaaaagacagaagaaatcctgcaaatttgtaagtattctaggaaaatatgagtatagattttttaaggatactctaaaaaataaagataaaaaatttaattcgaatgataactgtaatggatgtggaatatgcacaaagatatgtccagcagaaaacatttcaattatagataataaaccaaaatggaatgggaaatgtatagattgtatggcatgtatcaacatatgtcctaagaaagcaataaatataggaaattcaacagtaaacaaaaacagatatagaaatccatatataagcttatctgaattaataagaggtgagtagcagaaattttttaaaataaagactctaagaatatgttatacttggattataccatatggatttaactataggagatgaaaactaaatgaaatttagattagaaaatgaaaaagatttttttgaagttgagaatttaacaagagaagcattctgggatgtttatagacccggctgtaatgaacatcttgttttgcataaattaagaaatgcggaatcttttataaaagaattggactatgtcgcattaaaagatgacaagattataggaagtatagtatacagtagaatgttttttggaactgataaaaagatgtgtgaagatattatttgttttggtccaattagtatacatccagaatatcagaaaagtggtattggaaagaagcttattaattatactatggctaaagcaaaagaactgggatttaaagcagttttaataacaggagattcaaattattataataaatttggatttgaatgtgcaagtaaatacaaaatactgcttccaggaatgtcagaagaggatgaagctgaattttttatggtaagagaacttgaagatggatatttgaaaaatatgtgtggtatttatgattttgattcatgcttttacataggaaatgatgaacttgaaagctttgaaaagaattttcctagcaagattaagagagaaccacgtagtacagatttaatgtaattatgtagggagctttttagtaaacaacaaattttgtatggaagaaggaatacaagttgatttcttttccataaatgtgatatattgaattaaagattaccaccgggtaagaatgtagcgagcattcatttgtacatcattaggtcttagaagatgtgcaaatggatgcttttttgcaaataataaatttacgatttaagaaattggagggaattaaatggaactaaaaataataaatcaagatttttcagtatgtaaagtcaaggatttatcacagattgattattctgataaattttgctttataggaaagacagatgaggaattttcattagtatgtagtactgatttagtaccagaaaatataattgaaagtgacaatggatggaaagcattcagaatagagggagtattggacttttcccttataggaatattatcaaaaatatctagtttacttgcagaaaataaaattggaatatttgcaatatctacatataatactgactatattcttactaaaaaagagaactttgatagagcaattaatgttcttaaagataatggatatgaaataaaatccggtagctaaaatatacttacaaaatatgttataattggttatgaacaaatttgaatttgtaggggtgtaaatagatgattgggatatatttaagtggtacaggcaatacaaaacactgtatagaaaaattagcgtatttaatggattctaaatcaaagactattccattagaggatgataatgttattgaagaaattaaaaaaaatgatacagtcatactgggatatccagttcagtattctaattcaccatttatggttagggattttataagaagaaattctatgatttggaaagataaaaaggttatttgtgttgcaacaatgggggcttttagtggtgatggggctggatgtagcgcaagattgctaaaaaagtatggagctataatacttggtggtttacatattcatatgccagattcagtgtgtgatgttaaactgttaaaaaagactgttgaaaaaaataagaagattgtaataaaagcagataaaaagatagaaaagactgctgaagcaattaaaagaggaatatatccacaagaaggaataaatattttatatcatatagctggtcttttggcacaaagactttggttttatggtaaaacaaaaggatattcagataagataaagattagtaatgattgtgttggctgtggtgtttgttcaatgagttgtccaatgaaaaatataacaataaagaataaaaaggcagttgcagaagatagatgtacaatgtgttatagatgcataagcctctgtcctcaaaaagcaattactcttttgggaaaagaagttcatgaacaatgcaggtttgaaaagtatatttagaaattaaaatttaggagaatgaaaaatgaaagaatatataatagatgaagaaaataataagataagatatcacgacttgccaggtgaggatacaccaatattatttattcatggtttgggatgtgcaggttcatttgactatccagaagtagcggcgcaaactgacttgataaatcatcgaaggatattagttgatttacttggcagtggatttagtgataagccagattattattcgtatacggtaaaagaacatgcagaatatctatatagatttatacaagatttaaaacttgataaattaattatttttggacatagtttaggtggggcaattgcaattgagcttgcaaataaatgtacccagaatattcaatctataattcttagtgaagcaaatttagataaaagtataattggatcttcaagttatgaatttggaacctgtaaagaggaagattttatatctggagtattttatgaagtggtaactgaaaatatggatgaaaattctatgtgggcagcttctttatcagtatgttcaccagaagcaatgagtagaatttctcaatcagcagtaataggaacagaaccaacatggcgtgagatattatattcattaaaatgtaaaaaaacatttatttttggtgaaaaatcattacctgataaagataaaaatgagcttaaaaagcatggaataaatattgaaattgttaaggaagcaggccactctatggcttgggagaaccctaaaggattagcagaagcaattaagaatgggattagatagcaatgtaataggtattaaaatttataattagtagaggtgtagcaattatgaaatacgattgtggttttacaaaggaaaataattggtttagatatagggcagctgcaataattattgaaaatgacagtgtcctttttgtaagaaacacaagagataggtatttttactctgtcggtggtggagttcacatgggtgaaacagctgaagatgcagttaaacgtgaggtttttgaggaaacaggtgttgtatatgaagtagatagacttgcatttatacatgaaaatttttttgatggggatggatctcttgatggaatgaaatgtcatgaaattgcattgtattatataatgaagccaagagggacacaagaattaaatagcaatagctatactcaaggtgttagggaagaaatgcactggattcctattaaggatattgataaatacacagcttatccatcttttcttaaaaaagaaataggaaatttacagcctggaatcaaacatgtaataactcatgaataatttttatttcttatgagctaattacttattagaacaagacataaatgaggtggcaaattaatgttgtatgataatttgtatataaaagaaattggactcaaaaaagaaatttataaagaagaaagctatattaagaatttacatgtagtaaaaaatttaaatagattgtgtttatcaagtaatgttacattcttcgttggtgaaaatggtagtgggaaatcaaccttgctagaggctattgctgttaacatgggatttaatgcagaaggtggaacgagaaacttctgtttttcatcaatggaaactcattcagatttatataaatatattaacgtagtaaaaagtataaatagacctaaggatggattcttcttaagagcagaaagtttttataatgttgcttcagaaatagaaaatcttgattcgcaaggttctatggggaggtcaattatagatagttatggtggtacatctctacataatatgtcacatggagaaagttttataacgcttatgactaacaggttcggcggaaatggaatatacatattggatgaaccggaagcagcactatcgccaataaagcaaatggctatgcttactattattaatgaattggtaaagaaaaaatcacagtttattattgcaactcattcgcctatattaatggcgtatccagatgcagaaatatttgttattgacgatgatgaaattgtgaaaactccatataagaagactgataattacatgataacaagaaagtttttagaaaatcctgaaaagatgatggattatttgtttgaatagattatagtgtaaacattagctatataaaatagaaaattattttgctaactatgacatacagctgtcatagttattttattatacttaagaaaataagaattatttaaaggagaacagatattatgaagaagactattttatttgttatattacaacagtatgcagattgggaagcagcttatctatcatcaggtattaatatgctaggagatggaagttatgaaattaaaacagtatctttaactaatgaaagtattgcatcaataggaggttttcatacagttcctgattatgatattaaatcaattccttcacattatgaagctttaattttaattggtggaatgacatggagagatgaaaaggcgaaacaggtaaaacctttagtagaagagtgttttaagaaaggtaaagttataggaggtatttgcgatgcttcagcatttcttggtacagtaggaattttgaataatgtaaatcatacaagtaacgatttaaatgacttaaaaaaatgggcaggaaactcctataaaggagaagaaaaatatattatgcagcaagctgtaagtgataaaaacgttattactgcaaatggtacagcagctttagaatttgctaaagaagtaatgttatccttgaaagttgcaccagagaataacatcatagaatggtataacttccataaacttggctactataatgctgctatgcatgagaagtaaagggatagttgtaaaatatggtataataagtaaatggcaaattgaaattggagggtaacaatgaaaaaatggtatgatgaggaatacgaatttgaaattgaggtaataggatttcttaatagtgatcacacagagcgatattgtagaaatggtgaggaagtaggcgataagtacatctgtacatatggctgccctgtaaatacagaagggcagggtatttgttcaaaagtaatgatgattttgtttccaatcatggaagctgtccgaagtggtggagatttggagaacataggtggtaatggaaaatatatcaaggaatttgtatgtccagatggttgtgttatgttcaggttgacagcaaagaaacttggaaacgagaacttttataaggggaagtttttcggttaatgaatatgatttataggtaataaaggggtggatattataaagaaatatttaattaatatgtgaatattgctaggagggataattataaaatatttacctaatacaattacattagtaagaattatctgctcatttttattgtttagcttaaaaccatttagtgtttctttttttatagtttatataatttgtggattaagtgatgtattagatggatatatagcgagaaaattaagatatatcagtgaagcaggagcaattctagatagtattgcagatgttatttttatattttcaatgatgattataattgttccaatttttaaatggtcttggtggatgttagtgtggatagggataattattttaatgcgcttaagttccttattaattggatttataaaatatagggctctagcttttctgcatacatacagtaataagatgactggatttttattgttttgttttccatttatacactatatatttgagctaaatgtaactgtatgtattctatgtggagtagctactgtatctgctattgaagaaatattaataaatataatttctgatgagctttcaagaaatatagaaagtattgtttttgttagacgtgaaattccaattagcagagcaagtaacaataaatagtttaaattatagaaaatatactatattaaatacagcaacttaaggttgcgtatatttcgaaaatagaaaatgtaagttggtgtacctctgaattttcatcagctatactttagatatgaattaaagaggagggtaacaaaatgagttttggacaaaatttacaatttcttagaaaaatgcataaaaaaatgacgcaggaagaattagctgaaaaaatgaatgtatctaggcaaacaatatcaaaatgggaaatggaaaaggctattgcactttgcaatcttttttcttgctctttagatgaaatggtattaggaaatatagatttggataatgaagcttatactaatattcgtgtagaaaaagtatcttccttccaatatgtaaaatatgaagtgattagtcctcagccagaagatgatgcaaaaaaacatatttatgattgggctattaattctggtattaagcaacctgagattattggttgggatttcccctttgcttctcaggaacaaataaatgtataccatatgcatggatatgtagctgcacttataatacctaaacattcagaaatagaatgttctaaaaaaattacacagtcagatcaactttatgcaataattacaattaaagatccatttaaatcaccatttacaataattcctaatgcatacaaaacacttatgcgttatatggaggttaatggactacatcataaagaaaataaagaaatcctttcatgtttcgaaaaagaatataataaaaatggtagtgattacatggaggtatatattgctattgaataataattttattaataaatagatatgatttaaatagcaatggaatagtgttatatttttgtgcatgaatcttttatagcattatagatgtataaattttaaggctatatttcaacattaatatgaaaatatgcctcaagaaataagtaaaaatcagcaaaggagtagtaattttgatatgcgaagcaaaggaatactaccaaagaagaattaataaatataataaattaattgagaaagaagaaaaacatttaaagaatattattatgttaagattgttaactgttattttgggagctgtatgtttaataacaacatatttactgagacaaagttatatctttttatttataattttaataataattactttagttactttctttggatatacatatgaaaagataaaaaataaaaaagaaagtctttctatattttattatataaataaatcatcaattgatagattaaatggaaagtggaactcctttaaagatacaggggagagtttatagatgaaaaccacaattattcatatgatttagatatttttggtaataattcattatttcaatggacaaatacctgcaatacttatatgggcagactacgacttaaaagattatttacagaaatgcctaaagacaaagaagatatatatgaaagacaggaagcagttgaagaacttgcttcaaaagcatactttagacaaagacttgaggcggaaggaaaaagaatctctaataataagcaaaatttaaaagaacttttttcatggatgaaagaaaaggataaaattattaaaagcagtacaattactaatataattagaatgttatcgttgataactacagtactatcatcagttttaataattagaataattacaaatttaatttcttttgtattaggtataagaatttttttacctaagatagtttgcttaattccatattatattccaatatcactaattataatacaatgcattattctaagaataaataatgaacagagaatgaacaatttaattattgctgaaaaatatagcaatactatgatcacatacaaaaatattataaagtatatagaaaaaaataattttaaatctcaatatatagttaagttatacacagaactgtataactgtaacaatggtgaaagtgcttctaaggagatacgtgaattttcaaaaatttgtgaatctatagcaagcagacgtaatatgatttatcagattttaaatccaattattatgtttgactatcatttaaatatttttcttgagtcatggaagctgaagagtggagaaaattttgaaaagtggattaatgtaatagctgaacttgaagctttgtcaagcttggctattattagatataataataaacagtggagcatgccaaagtttgtaaatggaaaattagaaataatggctgaagagataggacatcctcttttaagtgaaaaacgagtattaaataacatcagggttaaagaacctaatcaagtgatactaataactggatctaatatgtctggaaaaagcacttttatgaggacaattggaatcaatcttgtattagcttatgcaggagcaccagtatgtgcatataaattttcctgtacaattatgaatttgtatacttgcatgaagataagcgacagtttagaaaagggcacatcttctttttatgctgaaatattaaagattagaaatatagttaaagcttcaaaggaaggacagcaaattctttttttattagatgaaatttttaaggggactaattcaactgatagacatacgggagctatgtttttaatatcacaattatgcaaaagtggaagtatcggatttgtatccactcatgacttggaactaggaaaaatggagagcagctataatttgaatgtaaagaattatcacttttcagagtattataacaataacaaaatttattttgattataaattgaaagttggaatttcaacaacaagaaatgctaagtatttaatgaaattggcaggaattgaaattgaataaaaaagttaataaagctatgattcaacaaatattggtagtcttaagaaatccagatattctatggtttgggtaattttaaagtattagcagtaataataaaccagaaattatcatatatttacttaaaaataaatttgtgatattattaatttaaatttttattaaatggaggaaaaataatggaaaccgaacccgggcctacgaatgtaacagctcaaattattttaatagtcattttaacattaattaatgcattttttgcctcagcagaaatggctattgtatcaattaacaaaaataaggtgaaacaccttgctgaggaaggtaacaaaaaagcaactatattactaaaattaatggaagagcctacaaaatttttatcaacaattcaagttggtataactcttgcaggattcttttcaagtgcatcagcagctactggattatcagggacttttggagaattattaaaaagcattggtattccatatagcaatgaaatagctttagttgtagttactgtgatactatcttatataactttagtttttggtgaattatttccaaaaagaattgctttgcaaaatgcagaggcaattgctatgttttctgttaaaccaattttatttgtatcaaaggtgacattgccttttataaaacttttatcattatctacaaatctactgataaaattatttggttttaatgtagatggtttagatgaaaaagtatcaaaagaagaaataaagtcaatggttgaagttggacaagaacatggtgtaataaatgaaactgaaaaagaaatgatagatagtatatttgagttcgatgataaattagcttatgaagttatgactccaagaactaatgtatatttaattaatatagatattccgttaagtgaatatatagatgaactcattgaagaaaggtattcaagagtaccagtttatgaaggtgatactgacaatataataggtattctttatatgaaagatttctttattgaagctagaaaatgtgggtttgataatgttgatattaggtcaatattgcaagaaccttactttataccagagactaagaatattgatgaattatttaaagaattgcagtcttgtaagaaacatatggctatattaatagacgaatatggtggattttcaggaatagtctcaattgaagatttgattgaagaaattatgggtgagatagaagatgaatatgatgaagaagtatcaactattaaaaaaatagattcaaatatatttatggtagatggattaatacccttagatgaatttaatgaaaaattccatacaaatatcgaagctaacaattatgatacaataggggatttgtgatcgataaattaggtagaattccttcaagtgttgataatgaacataatgttgagcatgataatttagtattaaaaatagatgaaataaaagaaaagagaattaatagaattaaagtatatattcaagcataaaattacatttaaataagcaaataaaagatactctgctaaaaataaagcagggtatttttttgtggagttactaaatttacaaaaaaaataacaataaacattaattaataaatcctacattaactgtgcatattaatattggtaaataataattacaaaaaaggagttatatcatgaaaaagaaaattagaatatttataatgttgcaagtaatggtgttgttacttaatattaattgggtaaattgttatgctcaaacccaagttatttctttaacacaagaacaacaaaataattcaaaagatattgttgatattgctagtgaagatggcagatttaaaactctagtaaccgctttaaaagcttcagggttagttgatacccttaaaggtgaaggtccatttacagtatttgcacctacggatgatgcttttgcaaagcttccacaaaatacagtcaatgatcttctaaaaccagaaaataaggatactctcgttaaaattttaacttatcatgttgcacctcaaaagcttactgcagcagatgtattaaagttaaatggtaaggaattaacaatgtcaaatggggagaaagctaaaatagaagtaaaaaataatgaagtatatattgatggtgctaaagttataattactgatattatggctaaaaatggagtgatacatgtaatagatacagttatgatgccatagatgaagaatatctaaataaaatgtcccttcttatagtagacagttaaaataaaaaactgtttctataatgggcattttatttttttattaggtcctttaaaataactcttaattgttatttatttctaaaatatgttaaaatattatataatttatatacacaatataaactattgtttcatgcttgccttggtttaattacacatcttttaatgtaaacaatgaaggcagtaatccatttttatttccaatggtaacatggggaaagttttttgaagaaaacaataaaattattatggaggtaatgcaatgaacaaacaaaatcatatgtcctactttggagttggtcctatctatgttattgtgacattcatattgacagctattgcagtttatatagggaagatgcaatatttttcaattggaaaaacacaaataatgaaaattccattatttatcttaggaattgtattaattgttttaggaattgttttatgggtacaagcagttattatatcaagaatagataaaaatattactgaaaataagcttctaacaacaggtgcttatgcatgggtgcgtaatcctatatattcagcttttacaattgtgtttacaggaatattatgtgtacaaaataatttaattcttttagtattaccttttatctattggttgtttttgagcataattgtaaaaaaagaagagactgtattagaaaaaatatttggacaagaatatttaatatataagtcaaaggtaaatcgttgtattccttggtttcctaaaagataactttaattttaatataataatggaaaagcacttataaatagtgattgcaaggaagtaataaaagaatgatgagatttaatggggattaatataattctaaattttacgttgatgacttaggggataatcttgtttattgtcagggggaaaacagtgaaatattgtcctaattgtggtagtaaatttttatataaagagagattaaagtcttggaatagacaatataatgaaattcattgctctagttgtagtgcagaatataaaaagaataatagaatagctactggattaagtgtatttattagctgcttcatatcattgataattttaaatgaaattaatttagaaattgaagtatatgtaataaagctagcattagtagctgtaattgcatttatttcatgctttataatattatatttgcttaatttgttcataaaatatgaaagagttaaatagaagctttttatgtgtgaagatataaaaagtataaagatatagtagataagtatactcatagttaaaaaatctttatagaacacttacaaaaacagaagcatactataattatgaaattaatattaaggattaaataatatgagtaataatgataagtatatagatgacggttcttggtttatatatgttccgaagaataagatttttgatggagcaaaatgtggctttagaggtgatatagagagtaatacaagtatgattaaggattatggtccaaagccttatgtagttaatattgatgaagctactaaggaaaataataatttccgtatagcattatggacaggaaatcatcttcaagttacattgatgagtattaaagtgaatgatgatataggtgtagaaattcatgaagatactgatcagtttatacgtattgaggacggacaaggaatagtcaaaatgggaaaaagcaaagataattgggattttgaaaaaaagtttgaagatgattttgcaataatgatacctgctggtacttggcacaacattataaatacaggtgacaaaccacttaaagtatactctatctatgcaccacctcatcataaacgtggcgtagttcatgtcaataaagaggatcaataagacaaataaatagtatctagcaaattaaaaggcgataaacattaaaaatttattgccttttcttatttcacctaatatgtagagaaaattttaaaaatctcttctaaaaacatatatttaaaatagtggccttattgtagccgcagtaatagtagcaatagggttactttttcatattatgtattataataatgaagggattgatagaacatgagcaaatttttaatttctgtagggcacacagcaagtggacagacaggttgcggagcagtagggttattggatgaatcaaattgcacaagagaaatagctcctttggttgtaaaaaagcttcagtctctagggcatacagtaattaagcttcagatagactctggaagttctacagattatgttacaagagtttctaaggctaatttagaaggcggagactattttgttgaaatacatcttaatgcaggggaggaactggttgtgaagtttatacaacaaatggatcatcagcttcaagtttagctcaaaaagtttcaagctctattgcaagtaatttaggtattacaaatagagggtataaaactagtagtggactttacgtattaaatcatacttctatggctgcaatgcttattgaatgttgctttgttgacaatgaaatagattataaggcttataatgcagaaataatcgcatcagctattgttgaagggcttacaggacagagtacattttatggcaatggaacatggatagctgataataatggatggtggtttaagtattctgatggaacatggccaacaggatgggctaagttaccaattggcaataacaattctaatttagggtggtttttatttgattcaaaaggatatatgaagacacaatgggaaaatccagatggaaactggtattacctaggtgaagataatgatggaagagcacgccaaaatgaatgggcttatgacagtaagacaagcaagtggtattattttaatgataattgtgctatggtacagtctaaatggataaaatataaaaatgaatggtattatctaaatagggatgggtctatggcaacaggttggcttcaagatggaagtaaattataccttctttacagtaatggtgttatggctcatgatactgtgctttatggatataaatttgattatgatggagttgtagcaaaagtataatgaatgttaagaaattttagaagttggtatggaacttgtgagcgatattacaaataaaatatttaatagtgtatttatatgttcccaagacttagattttgggaatttttttcgaatattaggaaattataatcataatataattaacatatactaatgattttttataaaaaagtatttacttaaccgttagagagtataaatatatagaggttattttagcgataattaaggagatgaaattatttggtcaggagtaatgaatatataccaccaattaatcccaaatatgaagaaagattaaaaatgttaaaaattgcattagaagaagtaaaccgtcctgaagattttgataatttagtagagttacttgctcctcctatagatattaccaacattaattcaacaggaaagtgtaaaggaattaaggtgggaataataggtggtggagtagctggcctagcttctgcctttgaattaagaaagcttggatttaatattacaatatttgaaactgaatatagtagaattggaggtaggatttatacttattattttgataaacgtaaaaagttatatggtgaacttggagctatgagaatacccataagtcatgaaaccgtatggcactatatagatctctttaatttaaaaacaagaccatttattcagaatgatgaaaatacgtttatttatgttagaaataaacgagcaagaaatgatttagaaggaaaaagtgttatggaaaaaatatatccagaatttaatttaacaccagaagaaagaagaacaccttggcaagagatgcttaaatatacactatcaaggaatcttttaaagataagtccgtctataagaaaagaattgatagagattaaagaaaactataatcgtatacttgaatattttgatagtttaaatattagagaagtatttgaagaaatgggattaagtaaaggtgcaattgatatgctctcaggagttaattcttttttgggcaatttttactacaatagttattttgaaaatcttcaagatgagtatacagtgaattatgcttatagatatgagatagtaaatggatatgtgaaaataccactagcattttataattctttgatggaaaaagatccaaaagaatattctaatataaaggcagaagatttaggaaaagtttttttgaaaaatggaaaaacagttattggaatatataaatcagataaaaataataaggtagttcttagatataaagatgagagaacgttagaagttaaaaatgaagaattcgattttgtaatttgtactattccattttcaagtcttcgtaatgtggaaatatatcctatgtttagtaatgaaaaaatgcaagcaataaaagaacttaactatgcatcaattcaaaagacagcatttgtatgtaaggaaaggttttggcaacgtggaggacctcatgaaaagataattggtggaggatcctatacagatgaagttgttggaagtatatggtatccgttttatgatgatagtagaaagatagaaaatagaaagaaatttaataaaaagaaaaattatcgtaataatagaggaattttattatcatcctataacttgaatcaagatgctattcgtttaggtaatttagaagaaagcagacgttttgaattaataaagcgacaagttgaaaatgttcatggcttacaagaaggggaattagatagcatagtagaagattataaaactgttctttgggataaagaaaaggggttttatggaggtgtttgttataataagccaggccagcaaaaactttttttgtatgcatcagctaaaccagaatatgataatagagtatattttgctggagagcatgtttcagttagccacggatgggtacaaggggctttaagtagtgctatgaaagcagctaatgatatagctgaatattgtaaagttatgagttctaattctatgaagtaaaacttactttacactgacgttgatatccattttaatatcagtataaaaattttagcatcccaattataaaaattacattgaaagtaagtaaacagacaggctattaaacctgtcttttattaattaattttttatcaaagaaaattaagactattatgattaatattattagaaagattaaaaataaggcggtatgaagaaaaaattcttttggaagtatcttcttgtagaagaggatgatacatatataacagaatttgataagataatttcagatataaaatatgatcagtgggaagaatttaaaaataatttagagtcatatagaaatgttagaaaaggtgtagtttatgctgttaattctaataatttgcaggaagcaaaaaatcaatatatcgaaatggaatcaataacagaaaaggtgtttgacagcattaacaatgtagtggaaacaaatttaaattatgcaaatgcagcaaatgaaagtaatcactcaacttacataaaatcaaggatgattatgcttgtattaaatatttttggaatattattagcaattatgcttggaattataattgcaagagatataattaaaccactggagaagattaaaaaatttgctgaaaatttagctctatatgatttttcagtaccaatttttataacaagaaaagatgaatttggacaaacaggtgtagctttaaatagagctcaaaaaaatgtaaatgaattagttaaaataataatacaagaaacacatgatatgagtgcatcaagccaagaattatcagcaacagttgaagaagtatcagcaacagctataaatattaatgaagctataaataatattgcacaagagatggagggagcaagtacaacttctgaagaaattagtgcagcggttgaagaaatggattcgggaattaatgcactttctaataaggcaatagaaggaagtaacaattcttataaatttaaagaaaaagcaacaaaggttaagtacaatagcaaaaaagctattgaggagaccggcatactatacaaacaaaagcaagacaaaatgttgaaagctatttaagacagtaaagttgtagacaatattaaaattatggcagatactattgcaagcatatcagaaaaaacaaatttacttgcattaaatgcagcaatagaagcagcaagagctggagaacaaggaaaaggatttgcagtagttgcagaagaagtaaaaaagcttgccgaacaatcatcacaggctgtgaactcaattcaaaatactatttcaaaagttcaacaagcatttaaaagtagtatagaaaatggtaaagacttgctagaatttataaataaaaatgtaaatatgcagcttgatactcttagatttttacatggagataaattattatgaattataaatcaaaaatttcgatacattttgctataataatatattttaatatttattttatatcaacagtatatgagtctagtttttggggagatattctctctccagtaggaaccattattgcttttataatgttattttatgtttataaaaaatcaactggtatgtatttaatatggctctttttaagtctaagtgcattattttggaccatgtcagatatagcgtgggcaatttgtgaacttattttagtcgtaaatcccccaaatattaagatatttaattttctgtatctcattcctaatgtatttattttaatttcggtattaatgttttttgttaaaatatctaaaaaattcaatagaattcagtttttacttgatattgtagcaatattatattcaagtataattattttttggaatttattaatgcacaatagttttattgcatttattagaagtttggataatttaatattatttctatacatggtatctgattgtattataataagcagtgtagcacttttagttttatctatacgaaaaggaagaataccaggcggaatttatcttactttttttgctggaggattttactcaattatagatttgctgtgttcatatgattatttttacgatttatatgttcctaattctataatagattcggggtatattttatcatttttattaattgcatatggagcattattagtattaaaggaaaaaaatgaatcacaggtaaaaaaattttattgtgaatttgaaaatagtggaacaagtaagaaaagtttcttgttgcttacattccctattatattcataatttttaaaggtttccaatatactgaattaattttgctaattctaacttatatgttttataaaattttaagcatttatgtacaaaatgtaattaaaaatgaaaaacttttaattaaagaaaaaaatatgaatcttattcttgaagaaaaaattaatgagcgtaccaaggaacttattcttaaaaataaagaacttgagtatatttcaaatcatgattctataactaaggtttataatggacggtattttaaaaatactttagatgatatgataaatagtgaaaatagcagtaataaaattacagttttatacatagactttgatagattcaaatcaataaatgatacttatgggcatgatgtaggagatgaagtattaattgaaatttcaaaaagacttgcaataacaaataacaaagataacatattggcaagactaggggggatgaatttgtattaatgatatctggaaattatagtaaggacgaaattgaaaatatagtaatcgatatgataaactgttgtaatgaacctatatatattggtacgtatgaatttcgagtaactattagtgttggtgttacaacttttcctgaagatggtgatacacgaaatattcttataaaaaatgctgatatagcaatgtataattcaaaatcaaaaggatataataaatattcattttttaattcttatatgaatgatataattttggagaaacatgaaattgagatgttacttagaaatgctgattacaataaagaatttcagcttcattatcagccacaaataaatcttgaaaatgaccaattagttggagttgaagctttaataagatggaattcgcctataaaaggcaatgttagacctgataaatttataaaaattgctgaggaaataggtgttatagaagaaataagtgactgggtaatgaaagaagcttctcgacaaatttacgagtggaatacaaaatacggattagatcttaagatgggaattaatatttcacctaaacagcttggtgatataaattttgtaaataaaataaaatatattattgatacctataaattagaaccaaaatggctagatattgaaattacagagaatatagccatgagaggtgaaaagattttagagaaaatatttgcatctttaaatgatttgtcaatttcaacctcaatagatgattttggtacaggatattcatcattaagctatattcaacaattctcatttaaccgtttaaaaattgctaaagagcttattgataagatttcaacagattgtagcaacaatcatatagttgaagcaatagttgtaatgtctaaatctttaaaggtagctacaattgctgaaggtgttgagaattatgaacaggtgaatattttaaaagatattggctgtgatgaaattcaaggttatgtatttagcaaaccattacctgcaaaggaactagagtataacttcagcagtgtggcggctaaatttatcttatttacaacaatgacgttatggttcgtgatacagttctttatggatatgaatttgattctgatggagttgcaactaaatttttatgataaagataaatactatttaaagatattatgcataatgaaacctgttgtctctgataatatattttagagaaaacaggttttatttataaaattaatttaaagacaaatatgaaagaatatacttaaaattttagtattatatctatgttatttaggaaaactataactagaaactaaaaggaggcataacacgaggaaaataaatatcttttattacttagagaagtaataaagcatcaggctcattttattgcaaaatggcagttagttggttttatccatggagtaatgaataccgataatatggcaattagtggagaaactattgattatggaccttgtgcatttatggataaatatgatcctgaaacagtatttagttctattgatgttaatggaagatatgcttatggaaatcagcctaaaattgcagcatggaatcttgcaaggtttgctgaaagtttgttacccattttacataatgataaaaatgaatcagttaaattagcacaaaatgaaatatcaaaatttattactttatataatgaaaattatctttcaggaatgagagcaaagcttggtatatttaatgaggaagaaaatgatgaaattttaattaaccagttgttaaatattatgaaaaagtataatgctgattacacaaatacttttagaagtttaactatggataaaactgaagatacagaattatatggtaaagaggaatttaataattggtataaaatgtggcaggaaaggctgataagacagaaggaatcaaaagaattatcgagaaagcttatggaaaataataatccatcagtaattccacgtaatcatcgtgtagaagaagctttagaggcagcagtgaaaaataatgattatactgtaatgagcaaactgttagatgttattacaaagccatatgattattctgtaaaaaatgattattatgttactgtacctaaaacatcatgcggtacttataaaacttattgtgggacataaatttaaaacctttttagtaaagtagagtacttgctaaaaaggtttttttgtaggtagatttaagcattattaaagtaatataaataaatttgaaagtgaaggtcagcttgatagtacaagttcacaggaactaaaaggtcttgaagatgaaatgaaaatttcatgtatggtgtgctatcaggatcaccttagttattattattttgattttataaggaagaatgaagatatttttgataattaataaatagtaggtgtattatttactgtaatggcgaatatatgtataatattgttgtgtatattaataaccgtatgcttaaaattagtatacggttatttaattatatatattttagtggtgataggatggtgtagttcatattgaatgaaatattagaaaaatacaaagagagactgattaatttaagtggcagcaatagagcattggtttgtaaaaagcttccgaaaaaaagagcttttgatttatggagattaaaaagaatagatgagaatatgtgcattaatattatagaatttattttttctgaaaaacaaggtgctttagaactgcttcctgattatacagaattgtttaataaaaaagaaaagtcaatgcgtagtgaaattaaatcagaatataatagtgaagttgaaattattaaaaatttaaaattagaatcaacagaagaaaaaaatagaatatcatctttaaaagaaaattatgaaaatagaattaacaaagaagtagaaaagttaaataaagaaagagatatgataattgatttttcagtttcattaaaggctttatggaaggaaattgatgaagttaataaggaaacgggaagaatggaattatatattggttatccttttgtggaaggaaatcttaaggataagacatttataaaagcaccactatttttatttccagtaagtcttgcaaagtgtggtgattcatgggaaattgaaaatgttaatgaatcaagtgtaatgttaaataaggtattactacttggaatcgcaaaacataatgagataaaaattcctagtattgatacagaatatgaaaagataagtaaaactcagatagatgaaatacttaagaatcttgaaaaagaaaatatatttattaaatatgaacatggtgaaatacagaaatttgaagaatacaatagtaatacaattcctgattataaccttgggactcttatgtgtaaggaaaatctagttatcggtcagttttctattgcaaattcaatttacaatgattatgaagccttattaaacatagatattcaaaaaaatattttagaggaacttcttaacagcaattatgatacagaaaaagcaaaagaggaagatgattctaaattaacttttgaagaaaaagatataaacctgatttctggccttgattatagtcaggaaaaggctgtaagtatggcagacaagactactaagatggtaatctatgggcctccaggtacagggaaatcacagacgattgtcaatataattggagatgcactgtctaagggtaagaaggttttgatggtatctcaaaaaagggctgctctagatgttatatacaacaggcttgaatctcttaataaaaaagctgttataatacatgatgcaaatggtgataaaaaaggtttttatgctaaaacagcatgtgcgttagaagaaattacttatgataataaagattatgtggatttaataagtgatgaatctagatcaattgatgttaaaataagaaatcttgaaaaaatccaaggagaaatgtttactaaaagggaatatggtttaacgcttcaagaaatgtatgaaaaatgcaagaatattaattcacgtgaagacagcagatatgatgaatttttaagatttagaaaaataaatagtttttcatcctataaataccatgatcttaaggaagctttggaaaagattgatgatgaatatattaatgattatagtgtatatagaaaacttgaaaatgaaaatccatttatagatgatattgatttaagtatgaaccttatggatattgatgaatttgcaataaaagtaaaaaagattatagaaccagttaagaaaattacagataaatgtgataaaaataaagtattgtatgattcattaatgaatttatatacagaaaacaattatgtaattgatgatagcaaggtagaaaaactggcaaatgaattaaataaaaatgagaatagctaccttcttgataagataaatgatggcaagtggtggagtgtacgctattggattaattattctaaaaataaaaataaagaaaatgaaaataaatcagaatttgaaactagaaaaagagccttaattgaagaaataaaagttatggcatctgatatagataaggcttttgaagaaattgcaatagttaaaaaagctcttagtgagagggtatacaacattgttattggtgaacttttaaaaggagaagatcttacacaatattttaaagatgtaataggagcattaaatgcaacaaatgattataaagaagttttacacaatataagaggcttaaataagatacatattgatatactaagttatgtttttgataaagatttaagtatttctaaaaacagactaaattcactattagaatttgtgacacttaatcatatacttgatatagaaaaagaagcagggataaaagaaattaccacatatattaataattttgatggaattgtaaatagtgttaatgcaataatgaaagaaaaacaaaataacgttcgaaactatataattgataaatggaataaaaaagcatcacaaataagcagctttgatggatataaagaatttaaaagacaagcaaataaaaagagagctttgtggcctattcgaagatatatggatgaatattacgaaatggttcttaatttgttcccttgttttttgttaagtccagaaactgtttcagaaattctacctttaaaagatggaatgtttgatatggtaatatttgacgaagcttctcagatgtatattgaaaatgctattcctacaatatttagaggaaatcaagttatagtagcgggagatgataaacagctaagaccaaatggtacattttcaaatagatatattgatgaagaagaaaatggtggtgaagaaaacagggctgcacttgaggaagaaagtctccttgatctggcaaaaataaattatgatcctgtttctttaatgtatcactatcgttcaagatatgaggagcttattaatttttctaattatgctttttatggaggaaaattaaagatttcaccaaacttatcatatgatgaagagaatcttccaattgaaagaataaaggttgatggaagatggattgatagagaaaatttagatgaagctgaagaagtctgcaatacagtatataagatacttaaagaaagaaaaaataatgaatctgtaggtataataacttttaacataagtcagaaaaactgtatagaaaactgtcttgaaagaaaagcacagaatgattctgaatttgcaactctttatacaaaagagatagatagagtagaaaacgatgaagatataagcatgtttgtaaagaatattgaaaatgttcaaggtgatgaaagagatattataatcttttcaattggatatgcacaaaatgaaaagggaagagtttctgttaattttggttcattatctcaagatggaggagaaaacagacttaatgttgcaataagcagagctaagaagaaaatatatgttgtaacatcaattgaacctgaagaattaagtgttgatgattcaaagaataaaggacctaaactctttaaaaaatatcttcaatatgtaaaagctgtatccgaaaacaataatgaatatgctaagcagatactgaaaaatgttttagatagtgaaataaatgcagagactgataatgaatttgacagtgattttgaaatagaagtatgtgataagcttagagaaagaggatatgaggttcataaccagattggtgtttcgggatacagaattgatcttggaatttatgatcctaaagagtcaaagtatattcttggaattgaatgtgatggtgctgcttaccatagttctaaatcagcaagggaaagagatattcacaggcagagatatcttgaatcaagaggctggaatataataagaatctggagcaaacactggtggaataatcctgattttgagattagacgtattgaagatgaagttgataggattaagaaaataatttattcgtgatgatgaaggtttatatattataacaaagattaataaaaatgaataatcagaaaagactattgacaaattgaaaaataagtgttaaataatcttggagtttgatataataggtatatattaatagatttggtggtgctatgaatggatagagatgaaagatatcttattaggataatgtttaaaaatagaatattttattcagatgcacaagcttttgaagatctttttactaaaattatgagatatggatatccagaatttagagcagttaaacctcaaggtgcttttggggataagaaaatgatggatatattattgatactggtgttttctatcaggtttatggtcctgaagacatcgctaaaagtatagataaagctattagtaagctaaaagaagactttaaaggtcttgtagaaaagtggagtgacaaagttactattaaagaattttgttacgttgtaaatgataaatataaaggtgctcaagtgactgttcatgaaaaattattagaacttaataaggtgttggatgagttacaaggtgaatatgctataacaacagaccttatggttgcaaatagattagaggatatgttatttgaacttactgaagaccaaattattgatgtaattggtagcttgccgcctagaactacagctttatatgatgtagactacaatgcattaaatgaggttattgaacatataatgagcattccggctaagaattatttggatgatttttatgttcctaactttgaaggaaagataaaatttaatggattatcaactttaattaaaaacaggctagaatcagcttctataaattatggagatgtagaaacttattttgaatataatggtgaatttttaagaaaggatttaagaaatagatttaaaggcttgtatgaggaatcaaagattcagatagatgatgaacagccacagtgttttgacagaaggtatatttatattttagaaaagagtatgccaaaacaagcaacagcgtatatacagcaagcagttgaatgtcttatggcttattattttgaaagttgtgatatttttgaagctccgcctaaagaggaggtttaaattatgattttacctaaaaagcatattaaattatcggaatcattatttgcattgggagcattagtattagaacaaattgataatccaaaaactgtagatgaaatctgggataatatatctcaaaaacaggatattataagtgcagcaaataattttgataatttacttcttacgttagattatttattttcccttggaattattacattaaatcagaaaggagggattaccaaatgtacctaaataagttaagtgctaatatgatgggatttcacacaataaaatttaaagacggcttaaattttattgttggtagaagagaaaacccagctatgaaagatttaaaggaaacgtataatggattaggaaaatcattgaccattgatataattcatttttgtttaggtagtaataaaatagatgcatttaaagaaaatttacaaggttggattttcacacttgaatttactattaaaggtgaaaagtatgtagtatcaagaagttgtgatgagcaaaataatgttatattaaacggtgaaaagacatcacttaaaaaatataataaaattatgcaagaaaaagtatttgatcttaatgatgataaaaaaatagactatcttacttttagaagtttaatttcacgatttataagaagatataaatctagttataataaatatgatatttatgtttctcaagaaactgattatcaaaaatcaattaataacagatatcttttagggttaagtgctgaactgatacagaataaaatgaaactaaaaaaagaaattgaacagttaggtagtactaaaaaaacagtagaaaaggatgctgttttaaaagaatattttgttgggaatgaagatttagatatacagataacagatttaaaagatgaaattaaagaggttgaaaataagataagaagttttaaagttgcagagaattataaagacatgcaattaaaagcagatggaatagctcatgaaaagaaagaaatattaaataggcttgtaattatagaaaatagtataagaaaaattgataaaagcttaaagattaaatcagatattcaattagaatctatactccaagtttataaggaagctcaagttgtttttgaggataaggttgttaagaatcttgagcaggttactgaattccataataaattacttcaaaatcgtcagcaaagattagaaaatcaaaagaactctatgataaatgaaagattatcattagaacaaaaagctcaagaatatgggaatgaattggataagttaatgtactttctaggaagtcatggagcactagaagaatatactgctataaacgataggttgagcgaattaaaattacgtttagaaaaagcaactgattataaaaacttattagaaacctatgaaaataaacttgcagaagcaaatattgaaatagaaaagcagaagcttcaagctaacaaatatattaaagaaaatgaagagttatttgagaatataatgagtgttttcagaacttactctaaaacattttataaggataaagcaagtggtttagatattaaagttaatgatggagctaaccaacttagatttgatattaatgctaaaataattggtgattcttcagatggaataagtgaggtttgtattttctgttttgacttaacactattaaaacttggaaaccataatgttaatttcttattccatgatagtaggttatttgcaaatatggatccaaggcaaagattatctttgataaaaatagtagaagacgaagctaaaaagtgcaatattcaatatatagcatctcttaatgaagatttaatatctacattaaaggatgttgctcctgaagaagaatataatcattatagtaagcttattgaagacaatactattttatcgttaactgataaatgtgacgaagataagcttcttggtatgactattgatattccatatgataaataatcaaaagccatttcctttgggagatggctttttaagtgtttatgatgcacttctagctaataattccactttctttctttttatattgattaaataataagttataatataacttatactaaaatgaagaataaagaaaatgtaattttgataaattacattctgtttattgatgcaaaaatattcttatgatactataactagtatagtgaatatattaatcaatggtgatgttatttttagtttaatcacaggaaatgcagctatagtaacaaaagagcatgagggatatctttacacacagaattatgtgaaactattgccttatgataatattgatgcacagtttttggtatatcttataaatgagaacaaagcaataaagagacagtttacggttggactacaggggtcacaggttttgaaatatacacttaagcagttgaaagaactggaagtaggtaaacttcctaatatagacaggcagaaagctataggacaagtttattttaaacagttaaggcttaaagcacttaaaaaaagagcagcagaacttgaagaatcaataatattagcaaaactagaggaggcaagtaatagatgaatgaaaatgaatttgaaaaagaattaatacagtatattacaacaggaacaataagtacacctgaatatttagaaggtggaagtgaattttcaactagtgagacatatggtgattatgtagtaaaaacaaagttatggaaatatgaacctgacattaaaaatacggaacagctttggaataatttcaaagaaattcttgaacagcacaatcaaagaactcttgatcatccactaagtactgttgaatttaatcaggttaaaaaaattatttctgacataaagacaccatatgaagcaggacagtttttatatggacttaatggagtttcgcaaatcgaaatagatttagatgatggacgtcatgtatttttgacagtttttgatcaaaaacagattggtgctggagatacagtttatcaggtagttaatcaaattcatcgttctccagttattgcaggtaaacaggaacgcatctttgacacgacacttcttattaatggacttccaataatacagattgaagaaaaacgtaatactcatgatgttaatgaagcgttgaatcaaatgcatcaatatgcaagtgaaaaccagtaccgtgatattttttctactcttcagattttagttgcaattactcctaataatgttaagtatatggcaaacacaacgccagataaatttaataaggattttgcatttaactggcagcgtaagagtgataatacaattgtgcgtaattggaaggaatttgcagattcaatgttgagtattccaatggcacatcagatggctacaaattacatgattttagatggtacaaaaaataaacagacattaaaggtaatgcgtccttatcaggtgtatgctactcagaatgtaattgaaagattaaagaaggttgatttcgagtttggcacaaacaaagtgggttacatatggcatactactggttcaggaaaaaccatcacaagttttaaaacatcatggcttgcaagccgcatgcctggagtagataaggtggtttttgtagtagacaggatagccttaacgaagcagacaaatgaaaattatacagcctatgatcctgatgccagtgaagatgtaattggaagtgtacaaaataccaataacactactgatttaagccgaaaattaaagagcaaggataacaatattattgttacttctgtacaaaagcttgatacattagtaaaacgtaaaactttcaaagctcctgataaaaatattgtctttatagttgacgaagcacatcgttcaacaggtggtgaaagttttgaaaaaatacaaaaagcttttaagaaatctgcatgggttggttatacgggaacaccaatgtttgatgaaacaacaagtggactacgaactgaagatatttttggtccgttattacatgcctatacaattcgtgaagctattgcagatagaaatgttttagggttcaaagttgattttgaaacaacaattgatgaagagcagatgaaaaatgaatatctgccagagttttataaagagcgttatccaaactgggatgaaaagaagatagaagaaaagattaataatttaagtcaggaagatatggatgatgctgttgagccaagtttttatgatgaaaatttagatcatgtaaaattagtagttgaagatatttttaaaaattggagaaatcgttcaaatgaaggcaagtacaatgcactttttactactcatgtaggaggtggaaaggctagtactccaatggcaatgatgtatttcaatgaatttcagagagtaaatgcagaaaacagaaaaaaaggaggacaaaccttaaaagtagcagttaccttcagtttaaatacatctaacaatgacagcatgcttgagactaatcaaggtttacatgatgccataaaagcatataacgatgaatttggtacaagttttggaatggatgatgtaagtggatacacacaagatgttacaagtcgcttgaacaaatctgctaatgataagaatttcttagacattgtaattgttgtagatcagctgcttacaggatttgatgcaccagaacttaatacactttatgtagacagaacattaaagggagcagggcttattcaggcttattcaagaacaaatcgtattgcagacatgcaggaaaaaccatgggggcgtattgtaaactaccgctggccagcacagaatgaaaagcttatgaacaaagcactttcaatttatgctaataaggattcagcaattttatctgaagatgaacagcgtaaagcaaatgaaaaagaagggattgtagcaaaaccttttgaagatgtatttaatgaagtaaaagatattgtaaacaaattaggtgacttaacaaatgagtttcagcaattgccatattcagaaaagcagaaagaatatatgcttgatttattacgtgattataatgctgggatggcaaaattaaagcagtatgatcctacagaagtatcaggagaaacagcaggttttgattatgacaatccagatgagttaattgaaaaattaggaatgacaagtgagcaggaagttatgcttactacagttttgactaatgaactgaaacaatatatatcaaaagaaagaaagattccagtatatcagatagaattaaagatgactcatgtgaaagatgtgaaaatagattatgattatttaactgagcttcttgagcagttgttgaatcaagtgcatgaaggaaagacagaagaagcaaaggatacaaaagaaaagattgatcaatttgcaaatggcttggaagatagaaattatgcgaataaaattaagaatgctacaaatgttattattaatggatattatccaccagaaggttcgaattttaaatatccagcaaagttaaaagatagtgaacatatcattcaggcagctaataatgtaagcatagacagattgtatctagattttagagtaaagtggggaattacagatattataacaagtgcaaagatgcgtgaattattcagcaatcatcattatggagtacaggatttagatgacactaagcagattacaaacataattggtgaagcaagcaaggattatcagacattagcccatgatgaagaaatacaggcattgtctagaatgaaatatcgtaataaactgcgtgaagctatatataaattagcagatgatcaggcagaaaattaagtattgaatggttaggtattaagtgatcattcagataggagataaaatgaataaaaacaaagaaaaagtacctaagataaggtttccaggctttactgaaccttgggaacagcgtaagttgggggaagtaattccaatagtaacagattatgtagcagcaggttcatttgctgatatagcaaataatgtatcatatatttcagaaccagactatgctcagctcgtaagaacagtagatttgaaacatttatttgataacaatggttttatttatgttgataaaaatgcatttgaatatttatatagagtgaatcttgatgaagaatgtatagtattacccaatattggagcgaacataggtgaggtctattatatagaaccttcgatgcttccgtatgaaaataatgttctaggcccaaatgctattttattgaagccagttgaacaaacaaaatttttatatacgttatttcaaacattggattttcaaaagaaattatctataattgtagcttcaagtggacagcctaaatttaataaaactgagctaaaagaaatcaattttgtattgccatctagggaggaacaagagaaaattggagagtattttaaacaccttgacaaccttataacccttcatcagcgtaagttgaatcatttgaaagataagaagaaaggtttactgcaaaaaatgttccctaaaaatggagaacttgtcccagaattacgttttccagaattcactgacccttgggaacagcgtaagttgggagaagtttcagaaaaggtaactgagaagaataaaaataatatttattctgaaactttaacgaattcagctgaatatggaattataaatcaacgtgatttttttgataaggatatatcaaatgaaaagaatttagatggatattatattgtccgtccagatgattttgtttacaatccaagaatatctaattatgcacctgtaggtccaattaatcgaaacaacttaggcagaagtggtgtaatgtctcctctttattatgtcttccgtacacatagtgttgacaaaatatttttagaaaaatacttttcatctaataattggcataaattcatgaagttaaatggagattctggtgcacgtgcagacaggtttgctataaaggattctgtatttcgtgaaatgcctattccgagtccagcgattgaagagcaaaccaaaattgggagttctttcagggtatcgacaaccttattacccttcatcagcgtaagctagaccatttgaaggaacaaaagaaagcattgctacagcagatgtttatataaaatattttttaaaagaggaaggaaataaatataatgagtaatgatatacaaacaataacaagtaaactttgggctatggcaaatgaattacgtggtactatggatgcatcagaatataaaaactacatattggcatttatgttctatcgttatctttcagaacatcaggaacagtatttagttggaaataatgttatagatgttgaagaggggcaatctataaatgatgcatataaagaacaggcagtagatgaagaactgaatgattatttagaagatatctcagcaagccttggatatgcaattgcaccaaatgatacatgggagtctttagttaataagattaatgattcccaagttattcctagtgattatcagactatttttgataactttaacaaaaatgcagaattaaataaagaagcagcaaaagatttccgtggtgtgtttaatgatattaatttaggagattcacgtcttggaaattctacaaatgaacgtgcaaaatcacttaataatatagttaaattagttgatgaaattgaatataaaggtgatgatggaaaagatattcttggtgaaatctatgaatatttaattggtcagtttgctgcgaatgcaggtaaaaaaggtggagaattctatacaccacaccaagtaagtaagattttagctaaaatagttacaagtgatgttaaaaaattagatgaattcttcaatatatatgaccctacaatgggttcaggctcattacttcttactgtagggcaggaactgccaaagggtacacctatgaagtactttggacaagaactgaatacaacaacttataacttggctcgtatgaacttgatgatgcacaatgtatcgtataataatatgatattaaataatgctgataccttagaaagtgactggccagatggaccagatgaaaaaggaatagatcgtcctcgtagttttgatgcagtagttgcaaatcctccatattctgcaaaatgggataatgatgaaacaaaattgaaagatccacgttttagtgactatggtaaacttgcaccagcatcaaaagctgactatgcttttatattacatagtatatatcatttgaataacgatggaactatggccattgtactgccacatggagtattattccgtggtgcagcagaaggaaaaatccgtcaaacattgattgaaaaaaattatcttgatgcagtgatcggattgccagctaatctattctatggaacaagtattccaacaattattttagttttaaagaaaaatcgtaaaaataaggatatattattcatagatgcaagtaatgattttgaaaagtgtaagaatcaaaataatttaactgatgagaatgttgataaaattataagtacatttaaagaacgtaaggatattgataaatatgctcatgtagcatcaattgaagaaataagagagaatgattttaatttaaatattccacgttatgtagatacatttgaagaagaggagcctattgacttggaagaagtaaatagacaattagaacaggacaataaggaaatagcagaacttgaagcagagataaatgaacaattgaaaattctaggggtaaaactttagaggtattattaattggagggtgacacgtacatcttccaatatttataaatgatgaagtttactagaattgaatttattctttgtaattattaaaatgctatataaaaaataaaataatggtcaatagtaaagaagagaataatgtaaacaaaactgatggaaatgagtgtgatttatgaatattaaaagtgttaatataaagaattttactgtatttgatgattttgaactgaatgtatcttcaggtataaatattattattggtaaaaatggaacaggaaaaactcatttgttaaaggggctatatgcagtttgtgaaagtgtaaattatgagaataaaagaaaaagcaataaaccctatgatatatcacagccttattttaaagttaattcaatggagttagttagagacaagaataatgggaataaagaaacatcaataacagcaaattatttaaatgatagttatgtaaaatatgtgattataaaacatgagggaatgaaattagcgagagatggttcagcatataaagatattaattttaatattaatggtatttttataccagcaaaagaaatactctctcattcaaatggatttttggcattaaataataagtatgatatgccattcgataagacttatatagatataattacaaatgctgaattaccagagtctaaggatatatctgaaattaataagaaaatattaaagattatttcaaagataattaatggtgaagtagtttatgaaaatgataatttttatgtgataaaaaatgatggcagtaaaatagatttctcaattgaagctgaaggtattcgtaagtttgctcttttatggaaacttataagaaatggattaattgataatgatacaattttattttgggatgaaccagaatctaatattaaccccgaattaataccaatattagttgatatattgattgaattgcaaaggtgtaacgttcaagttttaatagcaactcatagttataattttgctaagtattttgaagtaaaaagaagttcaaatgatagagtcttattccatagtttatataaaacagatcaaggggttaagtgtcaaagtgaaaataactttggagatattaaaaacaattcaattattgaagcggatacaagactattagatgaagttattgaaggaaactttgaggagtaaagtttatgggattaaaaatattaactgatgaaaacaaccgatataagtttgattttactaagtccaaatatgttattgaattccatgacttagctaataagatgaaattaaatgacgtagattttataacagaatataatgataacataattttcttagagtataaaaatgctaatattaaaaatgcagttaatccaaatgcatttgttgataaaataaagaaagaaccagagaaattttataaaaatatagcaaagaaatattatgatagcttaatgatgttttgggcagctggtggaaataaagatgactttcctataatatttattttattaatagaagcgccaattatggatgctaaaataagaaaacagctaaagctgaaaataggaaaacagctaccattgaatttaaaagaagatgttattgttagagaaatgctttcaaaatttgaagtgtttagtattgatgaatggaaagaaagatttaaagagattaatatagaagaaatatagtttggaaatatgatgaaatacatgcaaatgagtaatacgtctgaaatactactatagatggccaagggattaaaaaccttggctattttttaattcaattcacataaagaacgcattactaaatcaatatctttattttcaagttcatgtataatgtgcaggtaagttttctgagtagtagtcatacttgaatgacctaatctttgtgctacactggcaatagaaacaccagcaaataacaggagtgaagcatgtgtatgtcgtaaaccgtgaattgagattacaggtatgttaagttttttacaatgccttgccaaaatatcattaactgtagaattaaatacttttccttttacaaaaatagggatgtcttcctgtaggttttttaccaattctgaaaattgaatgacagtctgccagtcaatttgtattttacgtatagaagattgattttttgtaggaagaaaaccactgttgtctttataatcccaggttttatctattgataatatttgacgagagaaattaaaatctttaggtgttagtgctaaagcttctgaaaaacgaattccagtttttgaaactaaaagtataaaccaatcccagtttattgttgattttaagtctaaatcagcaagtaatgtgtgtaattcaaattgattcaagaatttgattttcttttctcttggagttttgcctttaattatggcttttctagtaggatcacgttctattaaaccttcatctaatgcatctaaaattgcacctttaagctgatggtgaaaatccattgtagtctgacgttcatggcataaagcataatcattaattaactgttgatacgtaatacgtgtcaaatcactaactttagtatcaggaagcaatttttttaaccatgtgtatgtcatatgatatttgtccagtgtaacttttctaatagctccttctttgtatatttttatccaacgttcatagtattcatagaataaatctgttttttctgctaacattaaaaatcctccattttttctataattttttccaatagcaagtacaaatagttgtgtgttttaaagtattaactatttttgcgtttatattcagaatacttcattaaaaatgacttacgctgatgaagggtaataaggttatctatttcattcatacattgacctatttttatttgttcttcatgagctggatattcaataaattgttgatgaagtacactacccttaatacctttaacagttccacctgaacttttttcattcagatttttctgaaatttaggtgacaagaaatagtattttaagtacgtattgtcgataatgtttatgtgacctcgatactttataattctttgcgcaagtgcgatgttggctatatttacttgtgctacattaccacaaggagcttctgtagtaattaatacatctccaatttcaggccttcctcttcgcattatttcttcataatcatcttctgcaatatattctttagacgattcataatctatatatccatctttaacattttttgcagtcactaggaaaattcctgaatcaattttgtttggagtttttccacgataatcaacataatcacaaacttcaatcaacttacgctgttcccaaacttgaaatatttattgaattatagtgatgaatttagggacaaaatttttagcaattctgaaaaggaatcatgactttaaatggacttaagatttgtagtggcatatgaactaaaatatatttaaaaaagttttgttataatctataattattattaaatacaaatagcgtataaggtttatatgagaaacctagcaggaggtgcagatatggattcagcacagaataatatttatgataagaatcattaggagaggataaattcaataggagttggaaaggtcatgactttgtagcgattaatgagttaacttaggatggattattagcagatagtgtatataaatcaaaatttgtatattttactaacgaaggaatagaaaaagcaaaagagttgattcccagatacttaaaagaacaataatataacaatatagaaggtgaatttatgaatataaagaattttgaaaatcatataagtaatacaatagttaacagaggctatgactactatgctaatgggaaaattgtggatatttatgaagatggagatagaaggtatagtttcacaattgaaggtagtgaggattatgaagtagttgtacatatagataatgattggaatattatatcttcatactgtaactgcccatatgattttggaccaacatgtaaacatgaagctgctacgtattttaagttatttgagatattaaataataaaagtacagatgtaagtacaatcaagcagaaaacatcattaaaggaaatattagaagggttaaagaaagaggcgcttattaagattattgaagagatagcagaagataataggtcaatacaaaaatcgcttatttttaaatattcaaaatctagcgatgaagatgaaataaaaaagtgcagagaacttgcagcaaaaattttagaaaagaacatagagagatataattatgagctgtatgataattatacaggcttaacggatgaattatatattttaatagacaagataaccaatatatataatatagaaaaaaattatgagcttgctataaaaatagcttttgaagtaattagtgaggttgaaaaagcaggtgaatatattgaagatttagatgatatctatagctttaattatgatgttattgatacattaggccagatgtgttatgagataaaagatttagattttgaaagacgtgaagatgtttttaatatattgataaagaaagttaaatttaataaagatatattttggggaaaatatactgaagatattttagctgtactaatgcagtttactgatatcgaaatattaagagaaaatcttaaaatgatcttgaaagatttaattattgatgaacatagtgaatttgatatagagagattatcaaaaatgttatttgatatattaaatgaatatggagataagaatgatagtgaaatatttttaaaagaacatttatattttgatacctttagggaaattatgattaatagatgtattgctaataatgattttgagaaggttatagagttagcttgtgatggagaacggttggcatcacataaatgggataaaggtgaaaagtggaaagtggaaaggtataacgcatataagtctttaaacagaactgcagaacaaatagatttagctaaagtgctatttttagatggtaactttgattattataatgaactaaaaatattatatagtggaagagaaatagaaatttataatgaactaaaagagaagttgaaaaataacacatataattttaattggaaaataaaagaggtgtatttgaagcttatagttttagaaaaagatttggatgaaatacttatctatgttagagaaaatacatcttatatagagaaatatgcacatattttagtagacaaatattatgatgaagtaaaggaaatatacataaatctaataaaaaaagaagctgatttagcaaattctagaagtagatataacactgtatgtcaaactataaaaagagcaagaaagatttttgaaaaagatattaatgtgcttataaaagaattctatattaaatataagagaaagccagcatttatagatgagctaaataaggtaaacataaattagtttattgaggataaatattctagattagatgtaaaagcaacgactagcaataaggaaacaattgcagtaaaaactgggttaacattagaagaggtagatacaatcagaaattaagagaatagtgaatagtaatcaaggttaagtagtaaaaaagtaaagggattaagaaaatacggtagaggtgtttaatcaacataaaaattaggctataataaaagataagaaacaaagtggaggtaagtcaaaatggagcaaaaaccacttccaataggaatagataattttgaaaaattaataacaagagggtattactttgtagataaaacacgtcttataaaggatttattagacaataaagcagatgtaaatttatttactagaccaagaagatttgggaaaacattaaacatgagtatgcttcaatattattttgaagatagaagagatgaatttactggagagaaaatagataattcttatctttttgaaggattaaatatagagtcagcaggtgaaaaatatactaaggatattggtaagtatcctgtaattaatctttctctaaaatcagcaaagcaaggaagcttgaacttagcatttcaatgcattagggaagaaatttcaaatgaatttaaaagacataaatatataatagaaagtgatgtattaaaagctgaaaaagaacattttatgaaaattgtaaataataataaggatatgtcattatatattacatcactaaaattcctaagtgattgcttaaataaataccataataaaaaggtaataattctaatagatgaatacgatgtaccgttagaaaattcgttttttagaggattttatcaggaaatgatagattttttacgttctttgtttgagtcagcattaaaaacaaatacatcactagagttctcagtaattacaggttgcttacgcatttcaaaagaaagtattttcacaggattaaataatttgaaaattatatcaattttagatgatagatatgcagaacactttggatttacagatgaagaggttagaaaaatttgtgaagattataatatagagcaaaagtatgagactataaaagagtggttcaatggatatatatttggaggaaccaatgtatataatccatggagtgtaatgcaatatgttgatgatttaaaggctaatataaatagattacctaaatcatattgggcaaacacaagctcaaatagtatagtaaaaagtctcatagaaagagcagatgacataacaaaaggagaaatagaggctttaatagaaggaaaaactatagaaaaaccagtacatgaagatataacctacgatgatgtttttgataacttagataatttatggaactttatgctctttacaggatatttcaaaaaaataagtgaaagaatggacgaagatacccaagaaaagttcgtggagctagcaataccaaacctagaagttaagtatatttttagaactaagatacttaaatggttcaatgaaaaaataaaactttgtgatatgacaaaaatgtttaatgctatagtaaataaagatacagaactgtttgaaatagaattaaataatttacttctagatacaattagttttaatgatgcatatgaaaatttttatcatggatttttagcaggagttctttctaatatgaaaggatatatagttaaatctaatagagaaggtggcagtggcagaagtgacttatttattaagtcagtttcaagacgtggaattgctatagtaatagagttcaaaatagcaaatgacattgatgatctagaaaagaaagcagatgaagccatagggcaaatagaggatagaaggtatgatattgagcttagaagtgaaggttataagaatatctttaaatatggaatagctttttataaaaaggattgtctaataaaaataaaagattaaataatgtctatagaaaaatatatattattaaaacctttttagcagtaaagcacagctaaaaaggttttttttcaaagattatttaggagatgatatggtattttagcaatttctataaattaacattatttcgtttagcaataagactgcttatgtctgactttaaagctgatatgagcaattttccaagagaatcttttggattattttcctcatcaaagaagtcatcaatagaagcaaatgaaccaatttctaaaattgtatcgagtgctttttttaaggatttaaaatcttctcgtgtattaatatattcatttttatcaattccataaagccagtgttcttctggcagttgactatatgcaacaagcttttcaagaaatgcctttgatggtggatatctttttccattttctataaggctataatatccttcacttacattaagcttatgagccatttccgatttatttaagtgaagtgtatttcgatattcttctaacctctctttaaacatctttttcatctccttttttctaatattatagaataaattatcaaaaatgtaaaatattattttaatttgaatactaagaattgtaaaattatagccaaaaaatttataaatagaaagtattatatgaatataggaaaaatatttttataaattgaaaagttattttgtaattatgttaaaaatattcttaacttgaaaaataaatatataataataaaaataattctttacaaattaattcaaaatatttacaattaagtaaaacaaaggctaaaatataaagcatattttaatatgcaatttaaatttacctttgggattataaattcaataatttgaaaggagaataaaatataaacaatgaaaaaagaaaatatttttaagacattatcagaagtagctttagaatgtataaagataatagaggaggttactgatatatgattattgaagaaaatgaatttaatattatgaatgaagaagttaagaaggacatactcaaagacaattatattttatatggggaggacagtaagataagtttaaaggatggaggaaaaaatatggacaataatattagtggtattatgaagaaatataaatccgaaaggctttatacaacaggagaaattgcaaaggaacttggaatatcaagtgcagcaaggcttaacaatattctagaacataagaaaattcaatttaagcgtaatggaacatggatgctttattcaaaatatgtggacaagggttttgtggttatgcgtcactgtgaacttgaatgtggaataaaagtatatgacagaaaatggacagaaaaggggaggatatttattcacagtatatttgattaaattattttaaaatgaaacattataaatagaatttttggagggtatgggcgttatgagtgacaataagacttattattatatgaggctacatgaaaatttttatgagcgtgaggatatgaaagtacttcaaagcatgagagatggatatttatatactgacatactaatgaagctgagccttaaatctttaaagtatgaaggtagacttatgtttaaagaaaatattccatatgatgcagaaataatatcaacaattactggtcataggattgaaacagttgaaaatgcaattaagatatttgagaagtttaaatggattgaaattcttggtaacggtgccatttacattctcgatattcaggatcatgttggtaggacaagcagcgagggagaccgaaagagaagatatagaaaaaagatagaaagtgaaaaaaactttataagaaatagtgacgacaaagctatggagattgattacgaaagctgtgaaactggtaatagtgtatatttacaatcttttgaggaagaagaaagaaaaatagaatcatgtaaaatagaatcaaaagaaataaaaaactctgaaaagactcatgaagatttgaggaaagatattataaattctgaaaatgaaaatttttgtaaaggatttaatgaagatagtgaaattgaaggtttaaaagaatctaatcatgtaatgaaggatactttatataagatgggacaaaatagggacatttgtccaccagagaaagagaaaaatataaagataaaaaaagagaaaaagagaaagtataataaaaaccatataaaaaacaataacacaaggaaaaacgaaacctttgtggataagtcaaatttattaaaagaggttcatgacattgaaaaagatgagtatgttgtagtcaatgttttaaagcattttgaaaagtgtggttttattatttcttcaagacttgcagagtttgtaaaagctgatattactatttatggtgaaaaatatcttatggatgcagcaaatgtatgtgtaaaacgtggaaaacttaataattacagttatcttacaggaatacttcaaaattggaggacaaaaggatacaatggggaaacatcatcatataaagctcaaagcaagtgtattggatatacagaaagaagttactgtgaagtaaaggtggataaaaagataaatcatgcagcttatagtcctatgaggagtattttagatgaacaatcttagtgttatgcccaaggatttacgttgtgaagcagaaattctcggtgctgtttttcacaatggaaaaatcatggggaagtaataaatgaacttgaagcagatgatttttacagtactgcaaacaagactatatacactcatatgtgcaggctctttgcagaaggaaaggacattaaccttactcttattgtaaattcaattggaaaggataaccttaaaagtgtaggaggaataacttatatcagcaatataataactggtggattaaacataaatccagcccactatataaatatagtaaaagaaaaatcctatagaagaaaagtcataaaggaacttacaaaggctgttgaaaaaatatatgatgaaaaaaataatccatatgaaataactgatgctatggtcaatattcttttaaataagaaccttggaaaatcaaatataatgagggataatgaactgtttgaagctactcttttagagattgacagacgattaaaatcatctggggaaataccaggaatgaagagtggccttgtatcttttgataaaaatattggtggactcaataaaggtgaacttaacgttattgcaggaagaccttcaatgggaaaaactctttttgcattgaatcttattgatggacttggtaaaaatggttataagacttttttatgtgaactggaaatgacagcagaatcccttggtatgagaagactttcaagtaactcaacagtagaagttgaaaagatgaaatttggtatgctcagtgatgatgagatattaagcttgttcaaaacttgtgaggatatgtcaaagagggataacctttttacagattgttctccaggacagagtttattaaatattaaagcaaaagcaaaggcaataaaacagactcatggactagatgttatagtcattgatcatcttactcttatgaatattccagaaaaaagcacaagagatcttgcaataggtgaaataacgaagggacttaaatttatggcaaaagaacttgatgtttgcgttattattctttgtcagctttcaagagctgttgagcagagaatggataaaagaccaatgctttctgatttaagagagtctggaaatattgaacaggatgcagacatggtggcttttatgtacagagatgaatattataacagagattcagaagagggtggaatactggaatgtattattggaaaacagagaaatggacggacgggcacattgaaatttgcttatgaaccaaaatttcagaaggtatattcaattggaaattaataaaataccttcctgcatataagaaatgcttatatgcaggaaggattaatatgagaggggataagtattactctgcatcaaaagttgtgatttttctttcagtaagcttagcttcaactttgcttacataagcaccgttttttgtttcaaagatatcattagcaagaatgttatccataagggcatttgcctgctctgaagttacagtttccttaacaccagagatagttaaagaatttttcttaccagtttcagtcatgaaagttaaagttaaaatatattccataattttattcctccttaaaatatctcgtgcacttttctgtacacagattgaattttattattttattaagagtcaagagtcaaaagtcagataattcttttagacagattaaagcatctgcctaaaattaaaagtttaagtaaaatattatgcttgaactaactgatcacttacagtcatatagacatttctagtctcatcagacaaaactgatttaactgcatttgcaacagcaagtaccttttcaggatctgcaccatcttttacattagagaaagattttttgctgtaagtaggattaccaagagcatcagtaccctttcttacttcaattgaaaaacttgcgctttcagcgattttgttaactgccatattacattacctccttttaattaagaaaaattttaattgtttaatcgtaagtaaaattcattactcatgattttcataatatatatatggtttagttcatgaatttgaaaaaaataatttaaattatttttgttcagtttcacagctgctgtcaattaagactccaagccttgcagaaattatggtattaagtcttgttattgatgttgtaaggctttgaatctgtttttcaagacgtacaagaagatacgtacttactgcaacaggaaatccaacattacctataaggcttacaagttcattaatatccataaatttcacctcccttcataaagtaaataaaaggtgtttaaaagcatattattaacaattagtgattttatctatccaataaaggtatgaagtttattaaatattttctttcttgcatgaaacacgttaaaataggatatatttttcatctgtgcatatgtctttatgctatttccctcataataaatgcaattaataagttctttttcatcatctgtaagagcatcaagagccttctttaatgaatcatgaaggagattttctaaaacagtattttcaatatcatcattactttttagaacgtgagtaagtgaatcatctaaaacaagagcttcttttccttctgaatttctacgttttatgcttttacgaagaagataatgaatattattttttatgcttattgttgcataagctacaaatctatgagtttgagaatcgtaagattttatacatgcaaacaatgttttgtaacactcatttacaatatcatcaaaggtgtatccatctatgaatatatttttagatgttctaattataaaaggtctgaattcttcaagaattttatcttttgaatttatatcatgtgcttttgattttaatacaaggttttcaatatatgcgtaatccataaaccctccaaaaacatattttatatttaaagttgaagtaataatgtttattacaaatagaggttttaacatacaattatctggcaataaaaaacactgtatatagtatgttaatgggaaacatcccctatatatagtatatatgtttatgggtataatttttaaaaataaattatgtaatattgaaaaatatataaaaaaattatctgccagaggtcgtaaaaagacttggcagaagatgcttatgactattaacaacagtctgaatcacagtcacaatctgaacagcagcatttacatctgcgatgttttttgtgtttgtgatgttttttttctgagtctccagcagtgccactgcagttagaacagcaatcaactgcgttatctacaagcttgtcaagaacacatgatacattattcataagctgggagtttgaattcataaagtaatttgcagtatattgtgtagtccaccagtagagaattataaggagaattatcaaggcctgatactgtttagagattaaaccgaagctttgcatgccatttaattctccagcatcataagcattagcaacacaattgttcataccaagagtgttgttgagatcattaatactgttgctcaggttgttaaaatcaccgttaagctcatttatacatccgaaatcgtccataaatctctcatcctttaaaatatagttttatactttattctatggaaatagcaaccataatgattatgttttaaatagaaaaaattaaatattttaacaatattaaaatatacttcttaatataatattagaaataggttatatacatattaaaaatattaatatataaaaaatatctaagttgttttgataatgtacatattattcatttttattaagtctgatcatgaaaaatttaaaatattatataaagaaaaacttcacaataattttttaacttttttgaaatttaaagcatataatgtttacgttagtaagtgctatatgttttgacttttcttatatattttaacttgatagtttttagaatgacattgtaaacatgagtaatatcaaggataaattgttgtagtatttatatgggagattgtctatggaaaacaataaagtaataaatataaaaaataaattatttaagagtaaaaattttgattattctgattgtaagatatatacaccagagatggttaaaaaatataaagaatgtttcaaatttactatgaaggtaacaaagaatcatgataaaactttatttataatgtacaaaaaggttgaacagtggtacatgaatgaaaatataaattggaatatggagaaaattcacataaagacaaagcttggttcttatacaagcggtggttgtggaattgaagcctctcttctggctggtcttacagcaagtggagtatgtacttatatggatacttatatgaaaaagctcagtccgttatctctcgcaatttatgctgtagctgtattgttttttggtatgaaagtacttgctgacgaagataaaactgtggaaatgtataacatgtttttagacgtaattaatgaattagaagaaaaaaattactctagaaaataagcatattaaaagtgatttttacacaacatagtttcatagaaaggatgtgttgtaatatgaaaaatcaaaaagaaactaattgtagtagctgtaatactggagcaataagtagttgtgaaagctcacaaaatacattaaaagctgaaacaaatacaaaattatcaagtggatgtaataaaaaagatgcaggaaataatgcttggacttcagtagcacaaaattatgatattaaagaatcttgtgaagaacataaaaaagatgcgggaaataaccagtggtgctcaacttgtaaataaaaaaataaagcaataattattgaaaggcgtgattcttatgaacttttcaaaaagcaataataccaaggggcttaaacattatgagcgcgctggtggatatatttcttatgatccttcagttttaacagagcattatcaaattaaaggatttgagggcgatgataaagaagatcctaacaaatcccaaagtaaatggtgctaaattatctcacactattgaaaaggaactgcacagcagttcctttttaaatgtatagaaaatctaatgaaaaacagaacgtatgtttaaaagttatttaattatgatataattactagataatgaataaaaatttagatttaaatagattaattaggagattttatgtcagaggagttaaaaagtatattagacaatgtaatatatcttgatatagagacaacaggtcttgacgaaacgagcagtgaaattattgaaataggtgcaataaaatttaaagataatacaattacaacatttgaaactcttataagacctaggggacgtgttccaattggcatttataatttatgtacaggtttaagtaaagaagaactttatagtgcaccatctcttggaaatgtaagagaaagcctttcgcagtttttagaagatcttcctctaatatgccataatggaaattttgaaaagaagttttttagatatcatcttccacagattaaaaatacaataatggattcaatggaacttgcagcaatccttgaaccctatcataaagaatataatctaaatgcacttatgaagactgttacagatatgaataaaaatgaaattcacagaggacttgatgattctataaacacactaaaggttgtaaacagtcttttgtgcagactttggagcagtgaagaaaagaaaggaaaaaagagaactttatatgaaaatataaataaatattatccttatctaaaaaaatggtcgtggaataaacatcttttaaagcctccattttttatttacgatgattacgattatgtatcatataaagataagaaagaaaatgaaactttccttgagccattaaaaattgattataaaaagtatgaggaacttttaaaggacgagaagatatggaataatggtggagactttggatacacttatagaaaaaatcagctggaattttcaaaaaagattcgtgaaaattatgaaaaaggcgaaagaatatttattgaagcacctacaggtagtggaaagacctttgcatacgttattattgcagcaatcggtacatatttaaattctcttaagaaaagaaaagatgatgcaagcttcataatatcaactaacacaaaggaacttcaaaatcagcttatagaacgtgacataccaaatattttaaaaaagctttgtctttatgataagcttaagtttggtgccatgaaaggaaaggcaaattacatatgcatagaacgcttaaataaatgcgacaggcttgaaggtgatgaagagggaaacctggcacttctttttcttagaaggcttgcagaaaaaggtgagtatggcgacatagaaaatataagctattttatagtaaagcgctttaaccttgaaagatattttaaagatgtaacttgtgacagtgattcttgtaatcttgaaaaatgcataaagccatgctatttgagaaagagatataatgaacttccaactgaaaatataactgttattaatcattcgcttcttgcatgctggccatatactgaaaagaaaaagattaatcatcttattatagatgagggccataatcttatggaaaagtgttatgatttttttgcagaagaatttacaagtagcgaatttcttgaaagcctggatatgattgataagggacatccaaatataatagggcttcttttgaatttaaatgcatcctttggatttagggaaacaattgaaaaagataagattatgtatcttgtaaatgaaataatagtaaatttaaatatacttatgaatgattttagaaccatgaggcttgttagcggagaatatgatttcaatactgagttttttattccacgtgatgacttaaagacaatgactaaatgtcttcagccagaaataagtgcattaaaagaaagtatatatcctctttataaaatgcttaatacatatgtatcaaatattgttcttgatgatgaagttacaggtgataatgattataagaatataaatgattatattataaaattaaaaggaacttttgatatgctcgataagtttcttgaagcatcaactttctttgctaaaatccttgaaattgataaagaatatgatgagtttagattaaagacagttcctttaaatgtgggtgagcttgttaatgaacatatgcttaaagatgtgaagagcacaacatttttatcagctacactgcgtatagaaaactcatttaacaggataaaaaagcatcttggccaggaaaaagcaaatgattttttaataccacctgtgtttgatttgaagaaacagacaaagatttttgcacttacagatatgggacgttatgatgatgcaaattacataaagcgaatttcaaattttatttatgaaacgagtaagaagcttagtggacatgtacttgtcttatttaataataatataaggcgaaatggtgtatatgaagaactagaaatgcttacaaggggaagcaagatagaagttcatacaaacaaaaaatcaattaatatattaaatgataagaacagacaggcaataatacttggaacaaagggattttttgaaggaatagatgtacctggagacggtctgtcatgtgtaatgcttgataaacttcctaaccatagcccagagtatccaattttaagagcagttacaacatatcagcataagatgtatcaggattttaattatcctcagctttgtattaaggtaaagcagatttatggaaggctcgtacgaagtacttttgattatggctactttataatacttgatccaggagaaaatcaatatacactaagaaatcttcaacgtgatttaggaggacctgttatagagagtactacgtcacttaaagtattagaaggaatggaaagtgattataataattggaagaaacgtaatcttaacataatgataaagaagcttcagcgtgaaaaaaaagacataggtgtagagtttgaaggagaatctaagaaacataagatgttctgggaacttgaaggtgtggaaaatggaatttataattttaagaatataaattatgaacttaagggaaaactttaaaggattgaattaaatttaatttaaagaatatatagtattataacagaaggaattatacttagtagattctattaggtatatatatatttatcttggtaatattatcaaatttattgtgatacatgtgatcataatctttgatagaaattttaataatataaatgaggtggaaacatgtgtacagcattaagtattaaagcagataatggagagaattttttcgggagaaatatggatcttgcatatgagtttaatcaatgtccaatgattattccaagaaattatgaaattgaaaataaagttactggggaatatctatctaataaatatgcgattatggcaatgggaactataattgataatcatccagcattagcagatggtatgaatgaaaaaggcttagcatgtgcaggcttgaattttactggttatggttattttgaagaaaaaccagtagagggaaaaattaatatagcaccatatgactttataggatggattttatctaatcattctacagtagatgaagttagagaagaacttagtaatctagaattagttaatgttcctataaatgataaaacaccagtatcaatacttcactggatgattaccgataaaagtggtaaatcaatagtagttgaaaaaacaaaggataaatttgcagtttataataatcctgtaggggtaatgactaataatccaacctttgattggcatctaacaaatttaaatgagtatgtaaagttaagtcctgataatcctagtgatactagctggagtgataaaaaattatcaccattaggtattggagctggtactttagggattccaggagattttgcttcagtttcaagatttgtaaggattgcatatattagagctaatatgccatctatagaaaatgatataaaagctataactcagtttttccatatgcttgattatgttaagatggttaagggtggtgttattacagctgatggtttagaagatttaactctttattcttcttgtatggatcaagaaaaaggtatatattattataaaaattataacaatagcagaataaatgccgtagatatgaacaaagaagatttaaatgctaaagaaatcaagaagtttgagtatttaacaaaccaagatattaattatcaaaattaatgtgtgagttagaacttaacaactgatttttaagtgtaaagttagggtaaatataaaagtatcttatttttgattgaagtatagtcaaaaataagatacttttattttgggtttatggtattattttacttaaggaatataaagatttaattatttacatttcataaaatgcttaataaattagggggaaagcttatgaaagttaaagtattaaatataggtatatttgcattgagttttgtttgtttattgatagcagctaaattattttgcaatctaggtatttatgctgatgaatttaacacatcaccagatgtagtcttaggaggtaaaataggactatatatgaattggcttatgattggatgtgtttcactaatatgtgtattatctggtgtgaatttatttactagaaagaagtaaaaagttatgttagagagagggggaggtaataatgatgctacttacatggattataccgttggttatgatatgtgtttgggggttaggaatttatgcacttgttttattaataaaagcattaagaatatatatagataaaaattcttgattttattgtatgaaaaaaagtgagttagaatagtattaaattattgtttatacctgtgttttctaattaattaagacatatggagtgaaaggatttattattatgtttaataaaaactcattaaataataagattataaatacagttgttataattttatgtattgtattaatgtatataataattagttcaattattatatgggaaaaaacaagtgatttattttatattatatctggagttattgtaatattaggaatattgtttaatatatatcttttattaaaagagaaaaattaatttaattaacaaatagattttatcttctttgaaaactgaataaatcagtattttaataaaaatctgtaaatggaactcacatgtgttcaaccatttacagatttttttatacaaacattaaagagataattaataccatatagaaaagtatatgatattatgttaaaattaatatgatgggaatattaaccataaattttatatactagggggtaataataaatgaacagaaaaaagataagcagaatatctgcacccatatcaggaataatgagctttatgcttacaatgggggctataactatacctgtctgtgcagcagaaacaaatgggggtaatgcagtttatgaacaaagcactaaatctgactatagcacttacattaacaagacagaagaaaaggatggatttaagtttacaataagcaaggtggaagcatcaagaaacagaatgtttgttacatcacttatagaatgtccaaataaaataaccgatgatgattttaataatgcaatatttatgcttactgtaaagaaatcaacatgcgaatctaacagaactcagacaagattgatagatgacaagacatttgaagttacttttgatgtaagaagttttgaagactttccttcaattgctcaattaagatttgatgtagttattccacgatataatcttaatgcatgggttaatgtagaagcagatatttcaaaaaacttcaataatataatagaaaaagatttgtacatgcgtaatgataatgaaagaacaacatgcagcaaaatgaaaactgatatactaggaacttcactttattttaaggaagatgaatataatttcgatgatgttaattatgataatgagtattcagattcaaagattttaataaagtgtgatgataaattatatgaatttgatgatactgattataattataacagtggaaatggaattgaaggaaaatatacatgcagttctctgacatatgacatacttgataatgctaaaagtgtcattctaattcctttaatatgcaatattacaaataaggaaatacaagatatatacaatagtgaagaatataatgaggatgattatattaatacaaatgataatataagatacaagaagaaatttaagtttgatgatggaaaagatggcgaagttacaaaggtagaaagaagcgatgataaagttatattctacattagtactgattcagaaaagaagagcatgcttatggcatcaggaataaatggatgggcatggaatgaggaagatagatacaataattcagaacctgaaaaaataatatataaagatccagatagtgatcacggatatattattcagttcaataatgtgagcaaggattcaaactttaatatgtggactgatgaattaatattaggatatagcagctgttttgaaatgggcaatgaagtaaccgttaaatagtagattaagtgaagaggagtggatggtaatgataaacaagaagataggaaaaattataggacctgtagcaggggcaatgttatttattgcaacaatagggataatgccagttaaagcatatgcagcagaaacacagattttacaaaatagcacttcaaatatagaaaatgagaataagagttatgaaacagagcaaaatggtacaaaatttaaggtaagcgatattgttggtacaagaagtaagataaaattgaatgcaacaattacaagagaagatggtataaatattgataaccataggaatattgaatttagaatgtatatggaaaatgtagacagaagtagttcgggaacatcatgggatagtactgatagcaagacggttgagataaagaaagaaatggaaagtgaacaaggctttcctgaaaaaggtataataagagctgacttagtaatgggagaatatgactttaacggaagtcttataataccagtagattttactgaaagcttcaaacaatatgtggaaaagaagcttgatgttggagttgataatgatactaaaataacaggttttgaaagtgatatcattggaacacgtgttattgttagaaaatccgtagaagatgatgaaagatatggaggatattatgatggtaagatggatcctattttcataataaaggttggaaataagatttattgtgctgaaaatatgagtggatatagctatggagatgatgatgtttattatacatgtagttttgacacagaagcattaacttacaatgatataaaagatgccgaagaaataagcataattccagtaaagtgcaatttgacgtatgatgaaattaggaaaaaatataataaggattcatattatgaagagatgcagaataaaaaaatagtaacagataacgtaaaatacaataaagatattgaatttgcagatggaacaaaaggcagcataaaagtagaaagaactggtggtaatataaatatatattgcagttcagattctgatataaacagctttattgcagcattgggtataaatggtgtgtttgcagatgaggcatatgatagtgtttattttgaggaaaataagactatatttaaagatgagaatcaagaaaatcaatatgttgtacagattaaggattctcatcctgatatgacttgtgaagttgatatgagtgtgatttatttatttgctgataggtatgaactagacgatgagataaaaattaattaataaaccatataaaaatgaactacatttaaagaaaaaaactataaaagcgttagaatataaacagcataagactgtctagaaataggcagtcttatgctgttttgataaaagatttaatctatgtcccaaaatgatgtaggttcaagcgtatctttatctacagtaacccctcttaaatcattacactctcctagaaaataaatcagatattcattttcttcaacagcggaatcttcattagaatctaatatcttagctttttgccatggacatctaaatgtatttttagccatagttccatcagaatttaagtaataccacttactactatcaagaagccatcctgttttcatatagccttcactatcaaaatagtaccattctccatcaataagtttccaaccaattgaccatgaattatcttcagtattccaccatccataagaatcttttacccatgctgcatttgcttttacggtatatagtgtagatagggaaagtactcctaatataagtgctattatttttttgatttttttcatatattttatctccatcctgctatattttacatatcataacaattgtacaatattattacatttttgtgtttgttgtgtaaaataaattgatttatatgtataatttatattaggattaacctttaaaactgaaatttgtataggagatttaaaatgaaaatagtaataatacgccatggggaagtaaatatgaacttttactcatggattttttgttagaacattattacatgaattagtggaaagaggatttaaaattaataaaaataaaattagaatgaataacttggaagaaattactgcatataagtaagtttataaattacaatttatgttataatttattattagtgtaaatataaaactatatatgaatttatatatagtaaaatactgaattttactgaggaaggaatatttaatgaaatatataaagaaaataccacctacagatggtgatttaagtaatatattgatatcaacgggctggaagaaaataaaagaaccttcaaacctaaatgaggcaatcttcaagtcaataccttttatgattataaacggtattattttcatggtgattgcatattgtatatacccaccaatagaagagtttataaatagcaagaacagtattagtatcacattaaatataaatatcatgacgatactatatattgctattacttttttatttatgacaatacatgaatttattcatgcatgcttcatacctgatttcttgaagtcagataagacatattggggaattaacgtactttttggttttgtttgtactactgaaaaaatcaagaagagtagatatataattatttctataatgccatttattttattatcaattatatttccattaatactaagtacttttgggctattgaatgagtttatattatttttatgcttattgaatgcaatgggatcatgtgtggattgcttaaatatatggattatattaagacaagctccaaatggttcttatattataaacaatggtgttgaaacatattataaataattatgtaggatatttatgaattagtttatgtttttaatcaaaattgaacagcataaatgaaatggaggataaaatgaataaaaaaagtatgaaagtccataatttaattttccccatatggtttttaatcttaatacctataacgtggatttttattttgtctgcaaattttttatgggctaatgaaaggttctttgaaaattaaatattagggtattgaatataaaaatatatattaacaaataataaattagataaattaattatttggaggtatttaaatgtttgaacataagaaacaattattgcacgaagtaaaagtagaaaaagcaaatccacaatatgctgtattaatgcaagaacaattaggtggaggaaatggagagttaaaagcagcgatgcagtatatttcgcaaagctttagaataaaagatccagaaataaaagatttatttttagacattggtgcagaagaacttagtcatatggaaatggtggcacagacaataaatttattaaatggtcacgacgttgctaatgaaaaagttgaaaatggagaaattcaaacacacgtacaatgtggattatcaccagtacttattaattcatcaggagcgccttggactgcagattatgtaacagtaactggagacttagttgcagatttattatctaatatagcttcagaacaaagggcaaaagtagtttatgaatatctttatagacaaattgaagataaagaagtaagggcaactattgattttctattaaatagagaagaagcacataatgccttatttagagaagcattaaataaagttcaaaagacaggttcgaataaagattttggagttacagaagattcaaaactatattttaatttatctaatcctggtccttcacatgaagctccaaatccaacaccaccatcatttgaaaatactagaagataaaattatgtaaaacctataatatagatcattccataataaaactaaaaaactaattttatgtaaataccgtattattcaaaatgaatgtgcggtattttatatttagaacatttcgcaatacttagaaggtgcgctatagtaagaataatatcaagtttataatggaagaaatataaatttacaatttattatataatggtagaagtttattgacctactggataaacaggaatttatccagtataactatgttattaacaaaatttgaatttgtaaggagtagaaatgaaatacaataggactattatattaaaaaataaaaaacaatgcctgattagaaattgccaagcaacggatgcaaaggcagtatatgataattttaatctaacacatggacaaacagagtttttgctctcttatcctgatgaaaatagttttgatgtagaacaagaaaggcaatttctaattgaaaaggaaaacagtgataatgaaattgaaatttgtgcttttacagatgataaaattgttggaactgctggaattgaagctattggacataaagataaagttaagcatcgtgcagaactaggtatcagcatagagaaagtttactggggattgggcataggtcgtgcattaatagaagcttgtattgagtgcgccaaaaaagcaggttatgtccaattggagttgaatgttgtaggttataatatagcagcaattttattatataaaagcgtaggatttgtagaatatgggcggaacccaaaagggtttcgttctcgtactgttggttggcaggaagtagttcttatgaggttagaacttgattgataaatccaatttaattgttgagttaattcagaatattaatctattgagtattataggtggacaatcccacctgtattttattaaaggctatgtttaatatagactttaagtaaaatgactgatgaatacattactcataataaacagataaattataatttatggaggagcaagattgtgattattgaaacaaatagattgattttaagggagtatacattagatgattttgataatttatatgagatagtatcagaccctgaaaccatgaggcattatccaaagccgtttgatgaagaacgtacaagaggttggattgaatggaatcttgaaaattataaaaattatggttttggtttgtgggctgttactttaaagaaaacaggtgaatttataggtgattgcggcatatcaattcagaatattgatggggaactattacctgagattggttatcacatacacaagaaatattggagaagaggttttggtagtgaagcagctagagccgtaagggattgggcatttgagaatacagattacaattgtatttattcttatatgaagtatacaaatgttggttcatattctactgctattgcaaatggtatgaggaaagtaaaagaatatcaagatgaaaagaataagatttcatatgcatatgcaataacacgggatgaatggaagttactataatgaatagacagtatttaatttagacacattctatgctttttcattaaatcaatttgttgataaattatgtgatttgcctaatataggtaagaaattagaaacacagctcaataaaattggaatagaaaatattgagtaattaaaaagaaatatgtacagtggatagctaatgaattaaatgcagatatttttgaaagtaataaaacgaaaattagtttacattcttttatttaagaggggcaatagattataaaaatttaactttaagtcacaagattattatgtctattatgaagagaatgataagtaagaagaaaccagaagaattgagtgatgaaaattatgaatcaaaaaattaaatctaaatagcaaactgtaaaatcgtatcaaaattgtgattataaattagaatttgaaagagggtctaaaagtggtagcatataaaaatagagaagaattaattttagaaatttcaaaacgagcaaaattatttattaatgaatttgatgatatctctgaaaaagataaagataaattcattgatgaagtagatagaacaccagctcaaatgattgctcatcaagtaggttggatgaatcttattattgattgggagaataaagaaaaagaaggacaaaacgttataacaccagctccaaattataaatggaataacctgggtggattatatgaagatttttataatcaatatgaggggtatagtttagaagagctatgtattagttttgtaaaaactgaagaaaagattattgaattaataaatacatatacagatactgaactatttgaacaaggaggacgaaattggtcatcatcgatgccctctaattgggcaatatggaagtggattcatataaatacagttgcaccatttaagtcatttagaacaaaaatacgaaagtggaaaaaaattcagcaagcataagagtgataaattctaatttagtgaatagaatttgaagaacaatatgcagaaatcgcgcagaaaattataaaaatgttctttgaaaattgaataatatgacttttacaaaatatgttataattaatttataatagtattataagacaagttgctttaatttttaaactgctagataaattagaatttagctcttaaaataaagtaataattaaattggggaggatgaaaaaatgaaacaatatgagtatagaatagagcaaatacaaatagaatttaagagtgtgttgatagctgataaaagccaatataataaggaaattagtgagaaactaaatatacttggtaaagaagggtgggaattggctggtgtagatggaaagtggttttatttcaagagagaaattctatagtattgacactcatagtatccacttaactaaatttcaatttgtcgattagatattaagaacaattttctttaatgatgaatcaataaaattaaatagcagattataaaatcgtattattcaatatagtgaatttgcgatttttttagtgtgcaattctttaatataatgaacctaaacttaacaatataaattataaaaactaattaaagattgtacatttaataaaaagtaaaattatgtattaatataaaattacaaggtaaaagatatagataaagggatagaaaatgaaaaagataaaaataattattagtctatcattagtagcattaagtttagtatcaaatcctatatcagcaaatgcagaatggaagaaagatgataagggttggtggaattcagaagtaacaggattaacttatctaaagtggtgtgatatatggaaagaaaaatatggtagtgatactataaaggctaatactactagttataaagctattgaagatttaccactagactatagctttaatttggcaaaagaaaatggagatgtagtgtgttctttaatggaacaatataatgtacaaaaacttgataacttttttgaaattataataataaaacagcaaatttgtatcctaggaatttatacaagcatatataaatctaattgactgttggaaaaaagttactgacatcattttcaataagtgtattgtttgaagttttacaatacatattgctattgttgctagtgattctaaaattaagcaatatctaataattaaaacatatgagaaaaattaataaaattacttagatggaggaataaaatgagtaaaaaaagtataaaattctataatttaattttccctatatggtttttaatattaatacctataacttggatttttattttacctgcaaatttttttatagatttaattgttgtggcgttgacaatgaagttcatgaaaattaatgacattaaaaagaaagtgaaacatgttattacaaaaatatggatagtaggatttatttcggattttataggtgcaggagctatgtatttagcgactataatcagttttaataacaactctaatttacatgaatggtggcaaaacaatattgaatatgctgtgaattataatcctttcgagagtatttattctatggtatgggttactgcttgtgtgatgattgcagcaatatgcatttatataattaattataaactatgtttgaaaaagttggatatcaatagtgctcagaagaaaaagattgcgctttcattagctgtatttacagcacattatttattctatattcctacagctttattttttaaataagaataatttatctgaagagtgataacttaacatagaatttgaaaataatattgcaaaaaataaaaatacttgagcttattggaataaccattctatttccatttgttttaaatatcacattattcgaataataaagaatagtgtgatatttttttggggattaattcttatatactacgtaatttgaatatttgacttagtaactgataaaaatgttttttgaaaattgcataatgttaatttacaatttatgttataattaatatataatggtgaactttgctggctaatatttttaaattttgaagtgaggtaaaattagttaagttttacctattgtactatctgcatttgatgaataatattcttattttgagtagtaattaataaaatagcattagttcaaaattcaatattgtaaaaggagaatgtgatggaaattgattcaattaagactattatttctacaaacctcaatcaaactgaagatgttataagaaaagatatagaaaatttgcttaaaaattataaaatcgaactgaaatctttgagtaagatgataggtgtagattatgtttggttgaaagattatatggatggaaaaaataatttatacgatttttcaataatagggtaaatactggtgagaataatgaagagagtttgaaaaattcaaatattcctaatccttcacatttatgtaacatgatttttatgctgtctgaagggataataatggtaaatgaagatgaccgagttaaaggagtaatagatgttctaataagtgaatttgaaattagctatgaaaccttagctatatattcaggacttgagctaggagacttgcaaagttttatgaatgattctaattctgtttcctgtgagaaaaaatataagttagcagtggcgagtatatttttgcattatttatttaaaaaatagacaacttaatttacaatgttcagattttacttatcaaattataaaatgttctttgaaatatttatgaatcgaaaggagaaatattatgggacttattgaattaataaaggagattgtaattaatgataaaatattataaagtatctataataattttatctctaatctgtttgattggctgccataatataaagtttgaaaaatatgatgataaaaatttaaatattggtattataggtgaaatatcaaaagtcagaaaagataatattacatttaacaaaataggatttgaagatttggaagaagaaaatatattgaaaatgaaaaaaatattgaagatgtatactcaagaatttttaaaactattttagaaaacaaagtataatatttagtatataaaaatgtgtatataaaaaggagtgtcttatttatgaaattattaattaagcaaagagtattttcctggactgatacctatgatgtttatgatgaaaatggaaatacaaaatattatgtgaaaagtgagtttttttcaatagggcacaaaatacatgtatacagtacgcttacaaatttagaagtgggaagtatatcggaaaaaatacttactttcctacctgaatttaatatccatataaatggcagtaacgttggctctgtccgtaagcagctcacattattcagacccaaatatcacataaactataatggatggaatgttacaggtgatatttttgaatgggattatgatgttgtagataattttaacaatgaaattatgcatatatcaaaggaatttcttcactttggtgatacatatgtacttgactttattaatcaagaaaatgaaataatgggtctattactagtaatagctattgatgcagctaattgttctaaaggtgattaaaattagcactagaaatattttaattatttatatatggaggatatgttttgaagaaagaatttagtagaattgtttttttaattgatttagtattcattatttttatacctactatagctaaaatctttacccaaagtggttctgtattagattatataattccatatgtagcgaatatgttttctttactgacagtaggtatactgataggtatatattgcattgtaaataatgattaagtatatgtctataatgcaagtgttaaaaataaactgaatttaagtttatttaaatatagctataaggaactcatttattgatttaaaaggagttccttttttgctaactaattaataaaatgttctctgaaacttgaagtttaaaatattattattaattaaattacatattttattatactatttggaaatatttctttaatgttaaaaataaagaattctttaatttctgctaattgatccttagaatagatatacttaccatatccgaattgtccgtatttaaactttctatcttcatcattcattggtaatgtagtttcaggaaatatttctagtattcgatttttagccttagttgtatatctatgagaaataacttcaaatataatctgttcattaaattcactaggtaatttagattttatgttttcaattaaatccttatattctttttgccaattatcatagataaaaataggggcaattataaatcctattttgtaaccagcattagcaacctttacagctgcttcaattcttttatcaatagatgctgtatagtgttcataggtgtttatgacagtgggtgtatttatactgaacctaatttcagtatgattattatgatttgcatctaataaggtatctacatcattatatttagttacaaatctaaatcttcctttttcttctttgccaataaattctattgtcttttttaaggcattggtatacggttcaagtggaataggatcagatgtagctgcaccttcaaaaatagttacctgtggtaatctttcctctatatattctttggctctttttaatacatcatcaatgttagtaaaaactcttacaaaaggtttatcacctagctgtgtatttaaataacaatactcacatcttcccatacatccactaactaatggtaattgataattagctgatggtttacaagtttggaattttaagcttttacgtttacctacaactaatgtctgttttccagatttatattgttcaaataaattatcaccaggtatatgacttttaattttattagaagatgcatttattatttcgatattgggattattttttattttattgtaaatgtttttaccaacttcagtttctaatgaatctttttcaaatatgactcttttaggaataaacataatttcacctctaataattttatatttttaattggtttattttaagtttttacatatattgaatataaaatacaagattagataaaaatataaccaaagctaattagaaataaaaacactataactggcaggtgacattatatgagaaagcccaaattaataataagtaaatgcttaaattcagaaaaatgtagatttgatggtcaaggctatgatgataaagttatatctttattaagagattacgtagacatagaaactgtatgccctgaaacttctataggtttatctatacctagaaatcctctaagaattgaaaaagatagtgatgttaatagattaattgaagcaaaatcaaatgtagattatacctatcaaatgtgtgaatttgcagaagaatttataaatggaatagatgacatagatggatttatattaaaaagcagatctccatcttgtggtataaaagatgttaaagtttatcccaaagctcaaaaatgtagtataagtaagaatgctacaggtattttttcgagtaaagtaatagaaggaatgtcaaacattccaatagaaaatgaaggaagattaaaaaattataatataagggatgaatttttgacaaaaatatttgctattaatgattttaaatgtgcagatagtattttagattttcataataaaaacatattacttttaaaatcgtatagtacaaaaatcagtaaagaattagattctattgcaaataaacaaaatttaaatgaaaaagatatagatttatacaaaagcaaattatatgaattattaaataaaaaaagaaataagaaaagtaaagtaaagatttgtaagggtatatttgaaaactttaaagataaactaataaaaaatgaaatagattacttttataatttgttaaatttatatgaaaatgaaaaaacaccattcagctctataatagttgcactacaaatgtattcaataagatttaataatgaagaattactaaatcaaacattctttaatccatatccaaaatgtttagtaaatatatctgactcgggaaagggaagaaatttataaaacagtttaaggctcctacaagaactaaaattactgctattgtataaagtatactcattatgtaacctccctataattgatatcaatattatattgtgtaagttaatatttaatatacacaatgtataaataaaatgtaacaaagtaccaagaataaaaacaaattgtaaagcaaataatagttgtgtacaaaagtagtacaaaaaaataacgaggtgatacatatgcaaatgaatgcaaaagatcaattacaaagtgcttgtaaccaattatcaactgctcaaggtgctttaaatcaagctatgagtagtgttgaaaaaccagagaataaacaagaaatagaaaaagctttaaatgcaataaataatgccgtgtccgtatcaaatagtgcatgtcaaaactacagagattagtatctattaaagaaaccttggtaatttttattatcaaggtttttttatataaaaaatcttatcatatatctaaaatttatctaatatctgaaatagttagtagtgcaatgcaaatgtaattaattactatttatgttataattaatgaaaatgtcgatgcttaatcttaaataaagttatttaaaagatcaaattaataatttaacgtgaaatggggagtagaattgaaagggagagtgataaagtataaataaacaacttaaaattggttttataattatctcaattatagcatttatcattacaaccacattatataaaaataaaattgataatcaatatttcaaagtatactcatttaatggagaaaataaagacataagaataagtaatggaattataattgtatatccaaacaagcagatagttagtggtggtgaaatactatatacaggaagtaagaatgaaaacatacaatcatattctaaaaaaatttatataaatgaagaaggaaataatgacaatgtagtattatctaattcagtatcacttcaaaatgacaataaaggaatagtctttcctgatgaatttttattaaacaaaggtgtcggagaaataagttcggaaaaactctttagtgaagatttaaatattatcaaagataacttttatttttctcttgattattcaaaagttaatggggagaaaggaaattttataattaagttaaatgtaaatgaagttaaataaaataaaaaatctttctttgaaacttgaacaatacggtaatgaaattcatatcaagaaaatgttatagtatagcaattggattaagattgtaaaagaaaggtggataaagtatgaaacaattgtatttaattcaattagattatttattaagactttttattgctgcagtatgcggaatggctattggatatgaaagaaaaaatagaatgaaagaggctggaattagaacacatttcatagttgctataggagcagcgcttataatgattatatctaaatatggatttcaagatcagatagggtggccgaacatgtctcttgatccgtcacgtatagcagcacaggtagtcacaggagttggattccttggggcaggtgtgatttttatgcaaaaacaaaccatagtaggattaacaactgcagcaggggtttgggttacagcagctataggattatcaataggttctgggctttattttgttgggatagcagctaccgttattactatattaggacaaatacttttgcatggaaaaattagatttttatcatcgccaaggacagaaacattaatgttacagattgtggataatgcagatgctattaaattgcttcaagacatttttgaagataatgagataattatacttaatttaaaaagtaaaagagatgaaaaatcttcgttaattaatgttgaagttattataagagtatatgagtcatttaatatgactaaattcttaaatattttgcaaagtaaagattttataaagtctttagaattttaaatagtattaaagtaagcaataagatagcgtgtaaatattttaaacggagattgtaatggaaaacaattcaattagaataatgtgagaaacgaatatataagggggaatatagatgaaaatgtatatagtagatgcttttgcagaaaaagtattccaggggaattcagcagcagtttgtattactgacagctggatgaatgaagataaaatgcaggctattgcagctgaaaataatctttcagaaacggcatttatagttaaagagggagaggtttatcatataagatggtttacgccattatatgaaatagatctttgtggacatgcaactcttgcaagtgcttttataatagataattatattgcccctaataaagagataattaatttcacaagtcagagtggagatttacaagtaaaatgcagagatggtttgtatacattgaactttccatcaagaccaccacaaaaaatagaaaaattaaaagaagtagaagaggttctgggaatagaaataaaagaactttttacttcaagagatttaatggcagttgttgaaaatgaaaatattattaaaaatcttactcctaattttgataagatgaaagatttatcaataggtgatggtattatagttacagcagaaggcagcgattgcgattttgtgtcaagatgcttttatcctaaatgtggtgttaatgaagatcctgttacaggttcagcacattgtaatttaataccatactggtctgaaaggcttggcaaaactaaaatgaatgcaaaacagatttctgagcgaggaggaattttatactgcaaagattgtgatgacagagttgagataacaggaaaagctgttatttatgctataagtgaaatttttatttaaaataactaggagttaaaatataatctactattatttggtaaggtctttcattgaagtatagggtgtaattacaccaaaatatatgaaggtgatcctaagctatcagatttaattttggaggaaacgaaaatgtttatagtaaacttaacatatattagaccgctagaagaagttgaaaagtatttagcagagcatattatatttttaaataaatattatggaactgacaattttatttgttcaggaagaaaaaatcctcgtaatggtggtgttattttatgcaatgcaaaaaatatagaagaggtaaaggaaattattagtgaagatccttttaatttaaataaaattgctgagtatgaaattatagaattccagccaacaaaatattctgaaatatttaatgaatgtattaaataaagtgaaactgtgggtattgaggtgaaagcaaaatgaacaatctaggaagtataacccttgaaacagagaggttaataattcgaaaatttaatttaaatgatggaatatatgtgtataataactgggcatctgatgaaaatgttactaaatttttaacatggccacatcataaggcaaagggaatgtcagtaagctatgtaaactgggttattaaaaattatgaaaaagatactgaaaatacaatgtatgaatgggcaatagaattaaaggaacttggacaaccaatagggtcaattggtgttgtagcttttaataaagaagtggaaagtgttcagattggctactgtattggagctaagtggtggcacagtggaataatgagtgaagcattaaaggaagttataagattctttatggaagaggttgaagtgaaacgtattgaagcacgatatgatcctcggaatatacactcaggaaaagttatggagaaatgtggattaaaatatgaaggaacattaagaagttgtgataaaaacaattcagggatatgtgatacttcgtggtatggaatccttagaaacgagtattttaatagatgattttttaaatttaattcgacaggtgacagtcacctgtcgaatttcatatgtagcaaaatattatatttttgtaaagttaactttttcacaaaaaaattatatataatatattgtgaatccaatttgaattttatcactatatgagtaagagggaattatataatattatactgattatgtggtagataacattcaattatataattaacataggaggaatatatatatgaatgataagaaaaatactgatttaggaagcggttcaataggacagcttctatttaagcttgcccttccagcgattattgctcagcttgtaaatgttctttacaatattgtggatagaatgtttattggaagactagacaatggtgaccttgccatggcagggattggtgtagcatttcctataattactcttatatctgcattcagtgcacttataggtaatggtggagcacctattgcagctattaaaatgggtaagaaagataatgatggtgctgaaaaaatcctaggaaatagtttctccatgcttattataatatcaataatactcactattggttttagcatgtttaaagaacctatacttatggctttcggtgcaagtgaagctacaataggatatgcaacaggatatcttggaatatatcttttaggaacaatatttgttcaattatctcttggtataaatccatatataaatactcaaggatttgcaaagtttggtatgataacagttttaataggtgctgtaataaacatagttttagatccaatttttatatttggattagatatgggcgttaaaggagcagcacttgcaagtgttattggtcagtttggttctgctgtatgggcattaaaattcctgtttggtaaaaagagtattcttagaataagaaaaaaatatttaatgccagacataaaaattgtaggttctatactagcgttaggtgtttctccatttataatgcagtctacagaaagccttgttttaataagtcttaataatcagcttctaaaatatggtggagaccttgccgttggcgcaatggctattatgaacagtgtaatgcagataatgcttatgcctttaatgggacttactatgggagcacaacctattttaagttataattatggtgcaaacaagatggatagagtgggaaaaactttcaagcttcttcttgcatcatgtataacatatacagtgttaataggtggaactgtattgttattcccagaattttatgtaagtatatttaatgacaagcctgaacttgtagaaataacatcttggtgtatgagaatattctttataggaacattaatatttggaggacagattgcatgtcagcagactttcctttcacttggaaaagcaaagatttcattaatacttgctcttttaagaaagattattttacttgttccattaactttcatattacctgtattctttgaaaataagttactaggaacacttgtggcagaaccagtagcagatatagtagcaactttaactacagttatatgctttagtattttttataggaagcttataaaagaccacaagaatgtatcatctaaagagaataaatagaataatagatatattaggcaaattatattgtgagcattttagagcaatgtgatattatatttgacttgattatggacaaataatcatcatttataatctattaatatacaacattaatatggacaagtgtaatttatattataaaaaaattgtgcacttatgagttaatatggcgaaaaccctctaatttacagaaaattttaattataaaaaataatctttataaggctacatgacaatacatatgtgatataatatttctatggtaaaaattgagaaagaggttgatgcctggaaaatataaaattgttttttatttaaaagggattaataatttaaaggggtgtgctatgtcagaaggaatcagtaaattaatagaagagtacaaaagtaccaaaaaatctttagaatgcggtttaaaatggcttccaacaaatgaagctgcaagatcaaaaattgatgttatcaatatgataataagtgatttggagcagcttgaaagtcaatgtagatagcattaaaaataataaagccttaatgatttatagagttttagtatagatcattaaggcttttggtaatttatatgaaaaaatttttacaaaggcagattaatatgatataatctgagacgataacacaaacactcgtatattttcaggaatatggcttgaaagtttctacctgctaccgttattagcagactatgaggtgtaatattgtaaaagcttaaatattttatctattaattataagttataatatagttgttttaagaattttaccgagattacctcattataataacagtatcagtattttactgatttatttaatgggtagtctcttttttattttgattattataagagatagtactttagctattattaagattcatagaaactacatgaaatttacgatgttctgtgtctaataaataaaagacatgggagataaataaaaatggaagttacaagagaaaattgtgatgaattaaaagaagagacatcagattattacgaaagcggaattaaactaatgtatggcattaatgataagccgaagcttacaatgcagatacttttaggtttgcagcatatattcgctgcctttggagggataatagttgttccccttgttattggaagtgctcttggatttgatgcagctacatcaaccgctcttatgagtgctacaattcttgcagcaggtattgctacatttattcaatcaaagggtatagggccaataggatcaaagacagcatgtataatggggacagactttacctttgcaacaccagctattgcagttggatcagttgcaggactgccaggtattataggagcaactatcttaggtgctttggtggaagttattttaagcttttttattaagcctataatgaagttttttccaccacttgttactggtactgtaatatgccttataggtctaactcttttgccagtatcaattgactgggcagcagggggaagcggtgcttctgattatggaagtatgataaatattgctattgctgcatttgtaatgatatttacaatattacttaatcactatggaaaaggaataataagttcagcatctatacttataggaatgatagtaggatatataatttgtatacctcttggtatgattgatttttcaactgtgaaagaagcaagttggatttcctttcctaaaatatttcaatatggtgtggatttcaactttaaatatgtaataccatttataccagcatatttagttactacaattgaaactgtagggtgtttaaaggctataagccaagtttctggaataaaggatgatccaaagagaataggaaaaggcgtattatcagatggagtaggaagcgcaattgcaggctgccttggtacattcccaaatacgtcatttagccagaatgtaggtataatacctttaacaaaagtagcaagcagatatgttgcaattatggcaggtatacttcttgttatacttggattacttcctaagtttgcagcacttataaacataatgccacagcctgtacttggaggagtgggaatagttatgtttggtacagttgcagcagcaggaatacagacattaagcagtgtaaaattaactaataaaaatttattggttatagcaacgtctataggtcttggacttggtgttacatttagacctgaaatattatcaagccttccagaatggatgactatgatatttagttcaggtatttcaacagggacaatagttgctcttgtacttaatattattcttaaagaaagagatgataagtaaaaaaagatttttgtttcagaattatgtgttaaaataaactataagataaaaatctatttagatatgtataaaataggaataggagagaaagttaaatggaaagcttacgaagaaaaatattagaagaaggaaatgcattatcagaaacagttttaaaggttgattcatttttgaatcatcaggttgatgcacagttaatgtatgaaatgggtacatattttaaggaatactttaaaaatcataacataacaaaaatattcacaattgaaagttctggaattgcaccaacagcaatgactgcactgcagatgaaccttcctatggttacacttaaaaagcagggatcaaaaatattaaatggtgatgtttatcagacaacagttcattcatttacaaaaggtacggattatgaattaacattatcaaaaaaatacataaatgaagatgataatatacttataatagatgatttcttagcaaatggagaagcagcccttggagcagcaagacttgttgaaaatgcaggagctaaggttgctggaataggaatagtaattgaaaaatcattccaaccaggtccaaagcttcttgaagaaaaaggatacgatgtttattctttagcaagaatagcaagacttgataagaatgtaatagaattcgtagaagaataataagaaaagcagatatgataaaatcccaaagagtatcatatctgcttttctattttaatacataggaaattatgatgaaagggtaatgcttaaaggtagcatactcaactgaaaagcttggcgcatacagctttttatatgattttaacaagcgtaattatagaaagtaattatataaatatatttagtattaatatttttgaaagagtgaaagtagaattagaacgagggaatataaaattataaggattgttaagaaaaaaatttcgcttgcaatctatgtgcttgtctgatataatcataaccgaattaaagattaatattatagtcagttcgaaagcctcctgacttaaaataaaactacggttaaatagttggtatgacacgtattttaatatgcgagagtgaactttagagtcattaacgttttattaaggtgcgctatattatgcttgtttatcgtaggagttttcctgcgatttttttatttttagaattaaataattgagtctgtaacggatattttatagttatagactaataatatatatgttgcactattaaatttaaaattataaactagaaatcaaatagtgattttaatataaattgttaattgcaacatactttctatttatgccttgagtttgattttgtgtggcttaaaaactgtataataaaaattaataaagtatttaattttggaggaattatacatggaaaataatacaacaaaaagacttgtgagaacagctgttattgctgcattatacgcggtgcttacattatttcttgcacctataagttatggaagtatacagtttagaatatcagaaataatggtacttttagctttctttgatccattttatataggtggacttacacttggatgttttgtagcaaatatacttggaccaaatggaatggttgatgcagtttttggaacaatagctacttttataagcgtttatgctatatcaataactggaaaatatattaaaagcgatactaaagcattaatagttgcatcattatggccagtaatattcaatggccttataattggatgggaacttaattacttgtatcaacttcctttagtattatctattcttcaagttgcatgtggtgaatttgtcgttgtagcaatagtaggagttccagtaatgaaacttattaagagtaagtacggaaaggttctagcagctcactaggctgtttctccatgattctgggagtgtgaaagattctagaggctagatgtccatatatagaatatatattttaatacatgtaaataataaaaaacagtacaataaacaactaaaataattcgttaaatgttttaagggatattattgtttgtgttgtactgttttttttaatgaattatatataaatttgaagtataatttaattagatatgttctaattaagaattcatattggacaattgatcataaatgaatcttaattcgacatgataattcgacaggtgacagtcacctaagagcaggaggaaagtatatgaagcatagtaaagtaactggtttaaaagctttaagtaaaactaaatttttaagtatgtatgaagcagaatatgaaaatagggttggaaataaaaaatcgtggatgattgcttcaagaaaaagtgaagaagtacttaaaggaaaattctttgaaaataataaagatgatgatgatgcagtagttattgcagcacttcataagccttcaaataaacttgttcttgtaagacagttcagggttccagtaaatgattttgtatatgagcttacagcaggtcttattgatgaaggagaagactttaagacttcagttaaaagagagcttaaagaagaaacaggacttgatcttaaggatattgcagcatctaaaagtaaattatatctttcacctggaatgacagatgaatgtgtaaatcttgttttctgtacatgtgaaggagaattaagctgtgataacatggaagaggatgaatgcatagaaccaatgcttatatcaaaggaagaggctacagagattattaaaagcaataataatttagatattaaatgctatcttgttttacagaactttataatatttggagaaaaactgtttgataatttataatgaagtattatatatactgcaattgacaattgacaattaaggtgaaaatccttacaggattttaaaattatatgcagaataattattgcaacatatataattagaagacacatgaataaaaaatagaaatagggatatacttataatgtcttttaaacatatattacaaacattttttggcacagctgttgtatttaacagctgtgtcttttattaaaacaattaagggtaaatgatgccattatcatttacccttaatttttaaggttccttcgagaataatagatgctaaatattattctcgaaggaacctagtgattaaatatattactaaatttttaattactatcaataaagtagattatcaagtttaattactaaaaatattatgatgctattctaaatgttttaatgaattaaacctattattatgaaatataacagaaatatagctgctattatatacataggaattgaaatttcattctgctttttagtacatattttacaaattggatataaaataaatccaagtgctataccatcaataatgctataagtaaatggtattgaaattatagtaacaaagcaaggaaagaaatcactaaaatcttggaatttcatatttttcaaattctgtgccataaggcatccaagaattataagtattggagcaattgctatattcggaattatgtttataaatggaataaaaaataatgatgctaaaaataatattccacatataactgatgttaatccagtacgtccaccatcagtcattcctgcattaccttcaacagttgaaacaggagggctacatccaagtagtgcacatcctatagttgcaaatgatacggcagcaagtgattttgatgctttttctggagcaccaagaagctgatgtgtttgtgcataaagaattccgatattttcaaaaacaagaattagtgttaatgaaaatgttccaatccaaaaattaatatttcctatggcattaaagctcatattaaagaaaatatctttatagctgttaaagtctggtagactaaattttaatgtacttgtatctacaagaccaaaaactatagataatactgtaccgagaattattgaaattaaaaagcttcctcggacattttttaaaaatagtacaagagttaatatcattataaatatgaaaagtataacttctggactattaatcttaccaattgtaacaagggtagaactacttgcgactacaagtcctgatttttgaagtccaagaaatgcaacaaacaatcctattccaatagttattgattctttcaaagtatgaggaattgcatccatcaaaatttttgaaagaggtgttaaagcgattacagcaagtaaaattcctgcaataaatattgcagcaagtgcttcataaaaagtaagacctaaagtgttaactatagtataagttaccagagcatttattcccataccgggcattattattagaggagcgttagtaacaaatgcagctatcatacatcctgtgaaagatgcaaacactgtagatattataagcggttccattgctatatgtgcatcacttaaaatactggcatttacaactattatataaattgctgcaaaaaatgatgtaagtgctgcaagaacctcccctttaaaagtaacattgtgctctttaagtttaaaaaaattattcatcctttcatccacgccttcaatgttccctctcccacccacgcctaagcgcagacttattataacatcacagataaaaatagacaatacctatcgacaaaatattttcgtgtaacttgtatagtaatttgtatataaaataatacaagttgataaagtagaaataaaatttattagtggaagtattggaataacctagcttcttaaagaaatattatatactctttaagaaatgtaaaatcttttagaagtaaagctttaactttatcgtattagcattataagccataataagatttgaaaatgatttatataaggtgatataattattataatattaattaattcttgtaaaaaattcttattttacaaattatctattggacatgagaatcttcttaatagtagacaatttatattataagttagtggaaaaaattcaaactatataattggattaattaaaataaaaattgggggcgttaaagttgcatacagattttgaaaaaattaaaagaggaagcttaatgataaattcattatgcatatatacacatttgaaagaagatggtgtattaaaaaaatatgtttcattattagaatatttaaatggggaaaaaatagaaattggaaaagcggtccattactataatgattttatatttgaacttttagacaagtcaaatggtagttctttaaagaaatacataatagatagaatttttttggacaacaattcttttacaaaaatgattgatacaaataatttttcaaatgagtacataataaagcaggttaaatatgaactcaaagctttagagtatatatgtagtattagttcagaagatttaaaagaaattatcatttataaaaccaaggcaattgattttgaagacgagattataagaaatcttatggattttgaagatgatataaataacgaatatagttcttataaagctatagataagcttaagcttagtattttaaattgtgatggatggggagaatcgttagataatatcattgaattttataagatgtacggtacaggaatatttggagagtatagggcatttgtatgggaaaatgaagatggaaaatgttatttaagaggtgttgactcaccagaccctgtaaaattaaaagatcttgtaggatatgaagagcagaaaagaaaaataatagaaaatacaaaacaatttttaaatggatatggtgctaataatttattattatacggacagaggggaacaggaaaatcatcaactgtaaaagccataataaatgaattttataaggatggtttaagacttatagaagttgacaaagacaagcttgttgattttacaaagataataagaatactgaaaaataaaaatttgaaatttatagtgtttgtagatgatcttgtttttgaggaaggagaagcaagttattctgcattgaagacaatacttgaaggtggagtggaaaacagatctaataatatgcttatttatgcaacaacaaatagaaagcatttaattaaggaaacatttagtgaaagaggagatgagatacacgctatggatagtgttgaagaaaaactttcattatcagatagatttggaataactgtttccttttattcaccagaccaaaaggaatatcttgcaattattgatggaattgcagatgcagaaggtattgatgtagataaagaatatcttcacagagaagcattaaaatgggcaagatatcaaaatgcacgttcaccaagaacagcaagacagtttatgagctggcttgaaggagatttgaaaaataattattattagaatatttatcataaaaatggaaggaaaatgatatatttgtctaacttttcaaagaataagtattttgcaatgagtaatactaagcttgtaaggagatgatgaatgtgtcaaaaagtaaaaaggaaaagttaatacagacatctggagacttttcacaaagtaaagttaaatcttactcagaaagagaagatttaaagagtaaaaatcctgtatcaagaggtaaggatattacatttaatcaactttaaattgtgcacattactgattttcaataatcaattatatgtttattattagcaataaacatgtaataattagattgcaaaaattatgattacaattgtcgtttaatacttaaacaaaacctcaagttaaaatatgtctgtatgacttaaacttcatttttagcattacgtaggaaaaaagcatcatttcagattttgaaatgatgctttttttatattaattcatatttttaaacatgtttaatatattaagcattccataaccccattgaggattaggatatatatcaccaggtcttgtagaaactcctcgtgcaagataagttttaattgctttagcatatggatgaggataatttttatctatagttgcccattgaaatagcatagcgcaggcaccagcagctattgctgaagcaacacttgtaccatttacaatatcagttgtattattaggtgctacagtcagagcgttaaccccaccagcagcaacatctattgtatttacaaaattatcgctaaaagcaagccctgaataatttaatatattattattgctttgattatatgccgcaattgtagctgtaaagcttgaattgcctggatttgttagtgttccataagtattagcaggacttaaacgcgtattaggatagataagtccctgctgtggaatccaaatattaaaggatgcatctaaaattaaatccccgcttaatcttaatttccatatacccggttggagatcataaaaacgtaatcgtattagctcattaccagaatattcttcaggtatatagtaatttacttttagtaatgttttttcaaaaataaagttataatatactgtgttattaataaaagaattaacgacacctgtgttttctccagatggtgaaacaacatctatagatagtatgtttggagcgtcaacccatatttctatccatatgtttttctcttcaggagggacatcaagatcaattacttttgttatttcttcttcagaaatttccccggaagcatgagaaccagacataccttcattaccagtaactgtaacaataattatatctgcattaatagatataaaatctataaattgatctaatattgaatttccattatgatttccaaggttacttccaagtggtatatagataactaaaggagattctgatcttaatgaatactcatataaaaattctaaggcagcaaataaaacgacaatgttaaaaacaggaactgttgctctgaaaatctgtttataagacatatcttcaattaattttatagaaataaatctgcaatcaggaactactccttttaaatcaggattctttcctgttgctccaattaaacctgccattttagttccgtgaccatattcatctttacttggaacaattgaataaggatcattcccttttttttgttcatcaatagcagattgtatttctgcattagagtatatggtgccaaaaggaattttcatattttcatattttttatctgaatctatagtttgatcccatataaggtcaattcttgaaataccattacgatccataaattcttcgtttaaataatccaaacctgtatcgattacagctacagtaactccttttccagtaaggtttaaaggtagattttcaagttgaagaaaaccagcttgtgaagcgtcaagaggtgaaatctgttgtagtgtgtacatagcgcttggttttatatatactattgtagaaaaaggtggtccatcatctataatttttaaatcctctcttggaatagagaggattgcatacctatcgctaataatctgaataaaatacattggatatgactgaaattcttcctctatatttccttggtattgaacaagaaaatgatagtagtccttattttttaaaatattttctcgcatataaaatctcctaaattatttcttggaattctaataaatagtgtttttacagtatattcaaaaaagtcagcattgacaatttttatatttttattatctattcttgtataatcatatttttgaagtcttgtatatttatataattttgcaattatattgaaagttcctaataaattaaaatctccataccctgtttctctgtttggaaatctataaatattatttcttgtagctccataaattaaatagcttcttactttatttgagtacattgttatatcgtttttattaataataccccattgaagaagaagtgcacaggctccagcaattacagccgtagcagcagaacttccagaaaaagttgtagcaccacctccaggttttgttgttaaaatatctgtacctattgttgctaaatctggctttattgttgtatttgtggtaaatccctttcctgaagatgccattatttgattattatttccataataagatacagagataacattttgagcggtagaagggaaagtaagtgtagtgtatggatttggttcaagaaatactaatttttcaggaagaactttataaggtggaagccatatatcatatcgtccatcgagtatatattcacctgtaagttttaatttccatataccttgttttatatttttaaattctattctgataacatcatgacctgtatagtggtcaggtgttctataaaaaacagtaaattgagtatccgtaaagacaaatttaaaattttctattctgttaatttttacttttattaattttgatgattcctctgtaggagaaataacacttagagaagctttgttgggtttatgaatccatatagtaacgttaagctttttaagttctcttggaattaatagttcactaattgaaaaatctcctttagaatttatataaccagttgtatgtccttgtttatctccttcatttccaactcctgaaacaagacaaattccacgtattgtaccaatattagataaatagcttgatagaacgcttccgccatcgtggcttccttctgtagcaccaaaacctaagtatattaccatagctttattttggagtttaaaaaattcattttttaaatattctatccccgcaacaatttcagctgtattatatactggaacatcttctaataaattttcttttaacatatctttaaagttagttgattctataagttttacaataatgaaattacaattatttgcaattcctttaaagatatcggttgcacctctgcctccaataattcctgcaactctagttccatgaccaatttcatctttagatggaacaattgcataagggttttcattatttctatatgcacttatagcagcattaatctgttcatgtgaataaatttttccaatataaggatctccaatatcaggagtatcattacgtatagtttgatcccagatacttaaaattctcgaagttccatcttctcgtataaattcttcattaaggtaatcaattcctgtgtcaggaataccaacagttacattatatccatcaaggtttaaataaggatttatttttatgttgtttatattatctatgtaagttggagatatgtcttgaagaacaaacataagtcttatatcaacataaataatagaggttacatcatttaatagtctgtttaaattttctctttctactgtaataatacctagagtttcagtgagtacatttccaatagcgtaatcaacggtatcaatttgttctttaaagtttcctttatatttaataagataattttcagttttaggattgtaataaaaatcgtattgattatctaccataatatacacctcagcatttttataactattatattattatgattgtaattaaagaattaattctatttttttgctaataatatgaatatagttaattttctctatctgtaagtgttgaagattttagttaggagataaacaactttgaggaaaaaataacaaattaattaatggagctgtattatgaaaatattaagaaaaataataggtaaaatttcaataatattaatatttattaatttcataagtatgtatgtggtaagtggtaaaagtataataaatcctaataagataataaacgcaagtgtacttttgtataaaggtgatgataaatatataaataaggtaaagataagtcttgaaaatattcaagaaaaaaataaagatagaattaactataaattttatgatggagaagaaaaacaaagtgtccaaaatagtcagttgaaacaaatattaaaagaaggaactgatcttattcttctgaatatagtagatatagattcggctgaatcagtgataaataaaataaaaatgaacaacatacctgtaatactatttaatagagaaccagtatcattagaaagtataaaatcatacggaaaatctttgtttataggagtggatggtgcagagataggaagacttcaaggaaaaataataaatgaagcatggaaatataaagaaatatttgataaaaataatgatgatgtatttcaatatatttttattaagggtgaaaaagataatatagaaactcaattaaggagtaattatgtaataaaaagcttaaatgattatggtataaaaaatttgcaaatagcatcacaatattgtaattgggataaagattgtgctaaaattgttgttaaaaagtttctcctaagatatggaaatgttatagacggaatcatatgtaacaatgatgaaatggcagaaggaagcattgaagctcttcacgaatttggatacaatatgggtaactttaataataatagtgttattgtagttggaatagatggattagagaaagccttagaattaataaaaaatagggaaatgactggtacagtaattcaagacccagataaaatgactgaagcgttatatttgattggaaataatatggttcaaagtaaacctcctcttattaatacatcatataaatttgatagtagtggtgttactgttcgtataccatattcaggttatgtagttaatgattttgatgaagtgaaatttttgagaaagagtttttatatgataaatattaaataaaataaatgaattaatggagctgtattatgaaaatattaagaaaaataataggaaaaattttaataatatcaatatttatgaatttcataagtatgtatatggtaagtggtaaaagtacaataaatcctaataagataataaacgttagtgtacttttgtataaaggtgatgataaatatataaataaagtaaagatgaatcttgaaaagattcaagaaaaaaataaagataaaattaactataaattttatgatggagaagaaaaacaaagtattcaaaatagtcagttagaacaaatattaaaagaaggaactgatcttattcttctgaatatagtagatatagattcggctgaatcagtgataaatagaataaaaatgagcaatatacctgtaatactatttaatagagaaccaatatcattagaaagcataaaatcatatggaaaagcattatttataggggcagatggtgcagaagcgggaaggattcaaggaaaaataataaatcaagcatgggatgaaaaaggaatatatgataaaaataatgataatgtatttcaatatattcttattaaaggtgaaaagaataatgtagagactcaattaagaagtaaatatgtaataatgagcttaaatgaatatggtataaacactttagaggtagcatctgaatattgtaattgggataaagattatgctaaacttgtagtaaagagtctgttcttaagatatggaaatattatagaaggaataatatgtaataatgatgagatggcagaaggaagcattgaagcacttcatgaatttggatataatatgggtaatttaaataataataatgtaattgtagttggaatagatggattagatgaggcattggaactaattaaaaagaaagaaatgacagggaccgtagttcagaatatagatgaaatggcaaaagctttatatcttgtagggaataatttagttcaaggaaaagatccactgtataatacaaaatacaaatttgacagcagtggtgttgctattcgcataccatattcaggttatgtagttagtaaattttaataataatatatgcacaactaagatgatggtcatagaagctttacatacattgacttgtaaatataaagatgtctaatataaaattttcagccaaacagtaattgatgctgtttggcttattctgaaataaagaatataataagtgaattatagtataaatataaattgactatataggagtattgaagaagtatggaaagaatatctgaagtggctatgtcattaggatatttatttataccagaagaaattgtaatagatttaaatgacataaaaaaatatcctaataataaaattacaataattacaactggaagccaaggtgaaccaatggcagcacttacaagaatagcttcaggaaatcatagaagtattcaaatagaaaagggagatatggtaattatatcatcaactccaatacctggaaataaaaaagctgtgtctaatgttattgatgatttaacagaaaagggagcagaggtaatatatgaagcaatagaagatatacatgtttcaggtcatgcttgtgaacaagaacttaggcttatccatgcattattgaaacctaaattttttgtgccagtacatggagagtatatgcatttattaagtcattctaaaattgcagaaaatatgggtatgaataagtcaaatatatttattttagaaataggcaatgtgtttgaagtatctaaaaaaaatgcacaaatagttggaaatgtgccatcaggaagagttcttgtagatggattaggcattggagatatagggaatattgtactcagagatagaaagaatttagcaaaggatggtatcataacagtagttattgctataaatagagaaagcagaagtataatatctggaccagatattattacaagaggattcgtatatgttagagattcagaagagttaattagaggtattaaaggtatagtttctaaatgtgtagagagatgtctttgtaataatgtaaatcaatggtcggaaattaagagtattataagaaaagaagtagataattatgtatatacaaaaatgaaaagaaagcctatggtattaccggtaattattgaaatataaagtattaattaaaataaaaagaaaagaattaattgttacaaaattaaattggagaaagttgaaattttcaagaaattaagaattgaaaatttataatatcttgaaaatataaaagttcataggtgatgaagttctcattatacatactaaatatattttttattaattacatgaaatttatgataaaataaatatatgtttttttacttaaaattgacatgcggtactgaatgaatttgttgtgggtactacttgtgagcaattaatatttaaagcttaattgataaagttttgatactgtatgtagatttatacttgcaaaatatatattttaatataacaaataaaacaaatcatactaaagataaaaggagaaaaccagtgaaaagtaaagttattaagaatattttattattggtcctgtgtagcagtaccatttttagtttgaatgtagaaagtgtacaagctatatggaaacaggattctcaaaacagatggtattggaatgagaacggaaagaatgtaacagggtggaagtttatacaagaaaaatggtactttttttataataatggaattatggcaagtggatggttaaaagaaggagataagtggtattatttaaatactgctggagaaatgagaactggttggtttaaagatattgatggaaaatggtatcacttaagctcaagtggttctatgaatacaggttggcttaaggattctaatgggaagtggtattatttaagtgatagtggagctatggttacaggatggattattcttgatggcaataaatattatcttgaacctaatggtgaaatggcaacaggaaagataactattgatggtaaagaatacgattttggagaaagtggagctctaactgaaggagattcatcagttaatgacccttctcttgacaaagaagaaagtataccagatggaagtattgtagaagaaattagaaaaaaagcatatgttgtaacagaaagtagtccattaaacatgagacttcaaccctcatcagattctaaagttgttattactattcctaaaaatagcgaagttacagttataggaaaagaaaataatggattttataaggttgaatataataataagacaggctatgcaagtagtaaatggataagttttgacaaacctcaagctgataatggaaataataatgaaagttcatctggaaatactaatataacccttggttcaataagaactactggacctgaaaagaataacatacattattattctgatgataatattttttataaagtaaaattatcacctccatttacaaatagcagtggaaaacctatagtaggtaactgtacatggtatgcttacggcagaatatgggaaatgactggacatataccttatgatgctggtttcactggtaatggttatgaatggtggaatgctaatataagaagtgggaaatataagtatggacagactccaaagaaaggggctcttgcagtctggaagtcatcacttcctaattcaggaggatgtggtcatgtagcaattattgaaaaaatagaaaacaataagatttacatttcagaatcatcatggcatggctcatattttaattatagagagatctatagtacagatcatctttatggatatatttatttagatgaacctaacttttagtttgcatttgttttaattaataactagtatttttttagattcatatttgtatagaagaaattaatattatatagtaaatcaccttaagaacagaagttatctgttcttaaggtgatttttatgaatactgtcaaaaaagaattttgtaattttatcatctaaaatagtatcttttttatctatataagaattcatatctataactttgcaggaattgcacttatcttttaaagattcacttgattcatatcttatattatcattttccttgataatagattctcttttatttgaattatatttaacatacatatatttcataataaatcctccataacaataaaatataaatgaattttcatatgtttatatatatgtatatattatgtaaataataccttgaagattaaaatatattattaatgtttttagttaataatatatttagataaagtcttcatataaaagtgaagtctgcatattatgacatcttaattattttaaaagttaaatatattaataaagtatatacaaatgtgcattatttactatataatgtaaatattatcaataagttaaacataagtgtgtaattagagtatataagatgaaaaaatgtaagttaaaggatggtatgaagaatgtttgattttttaaacaaaaataaaaaagaggctgatatagaaaatacagaagaatcagtgaaagtaattgataacaataatacagatgataggtttgccttatatttattattctcaaaaaagccagagtttaatatatcaaaaatagaaagtcgaataagcaaaatatgtgatagaaatgcaaaaatacaaaatatattagaaaaagaagatacatttaatatatatgggactgctgaaattgatggagaaaaatttaaaatagtgggacttgatatttctattcctagtgaaataacagaatatacagttggctgcgcttatggtcagaaagaagaacttgaagctatggaaaatcatagttaccatattatagctttttatgcaggtaaaagcacagattataatactatatataatgcttatgctaagcttgcatatggatttttggaagataactttgttggaatggctaatggatatgcatggaatgcaatttcaccaggattattaaaaggtttatttgaagataaaagaatagcagagatggcttatacaccagccatgatggtgtggaggaattttgttaaaatgccatatggagataatgtttggttcgtaactaagggtaattttctttatggtgttcatgaatatgcttttaaaggtgattcctttgaggactcacagcaggtttatgatatgtttgaagatatttttaattatgaatatacagaaaggccacaaattggtgtaggtcatactattcagctcggagaggatattttcttaagatttagagatatttatgaattagaaaatgagcttgaaggtgatggaataggtacacttgttttagaatttattactgaagacgaaataaataagtagagagttttaagttcctaaagaatttttatattttatgaaatttttaataattatattcaaaaagaagaaatagctgaagtttaaacttcagctatttcttcttttagtacatattcatttattgccttaattactccattatcattattactttctgctataaaatttccatattgtttcatatcatcattggcattttccataacaaaactatagtgagcttctttaagcatttcaatatcattgtaaaaatcaccaaataccattgtttcttcataagaaatgttgaaacattcctgaatttctttaagagcagctcccttgtttacagacttaccattaatatctacccatagttcgcctgaaactacaactttattttcatcaccaaaaagggatttaaaactttatatgaattttctgaagagatattaagatcacatatggcaattttaaatatgttatcatcaacatcataaatgttatctaccacatgtttttcaatataatatttatctatttctttcaaataatcatcagagcatggcatatgatatgctccatttactccacataaaattacaactgtattttctattttttcacatgcttttataactgcatgtacaacgtctttttttaatccatttataacaggctgcatgtcatttaatacaacataagaaccgttatcacaaatataatctaggtagtcgcttttaggcttaaaattttcatagagtgttttataaggtctgccactggcagcaacaaattttatgtttctttcctttaatttttcaagcatttcaaagaatccttctggaaggcagcctttttcatttaataaagttccatccatgtctgttgctattaattttatcattatatgtcacctcgtataattatttatattttagtatgtatattgctaataattattttacattaaatataagaaatgtttaagatatatttaaaggataattctcaattattaattagattatatattattaaagctatatttctattaaatcttaattggaaatatgaagaaatagaaatatagctgtataaaatattacgctaagaacgaatcttattacgctattttatgttcagattgtttacactactcattatatataaaaaattctttaaatcaagaactaataataacaaacaataataaataataataaaataataagaaaataataataaataataaatatatgatataattaaattaatctaagaagatatttattattaaatatgcaataaaaggaagtgagataatgtttctagaagaaagatattcaaaaataattgaacttgtaaataagaatggaagagttgcagttaaagatcttgcaaaagaatttgaagtaagtgaagattgcataagaaaagacctacgggaacttgaaaatagaaagaaattaaaaagagtttatggaggtgcaatagtaaatagaggtcatagtgatataaaatctgttgatgagagaaaaaacgtaaatacagaaataaaaaagcagattgcagagaatgcaattgatatcatagaagagaaagatataatttttcttgatgtatcaaccattaatcttgaaatagcaaaaaaattaaaagattcacaaatcaaaattacagttgtaacaaatatgcttgaaattgctatggaattaaaaaaatgtagtaatataatgattataactgtaggggggacatttaattcagaagttggagcagttataggtgcagctgcagacaggtacataaaaaactttacttatgataaatgctttataggagtgtgtgggataaataaggaaagtggggatgtaagcacaataaatcttgaagatggaaatacaaaaaaaacaataatagaatgttctaataaaagctatcttgtaatggaaactgaaaagtataattatgatgagttttttaagtttgcaaaattagatgaagtaaccggaattataacagaaaattaaataaaataatatgcgaaaaatataatagaaataaataaatttcaaacaaaataaaaaatattttaataaaatagaaatatgaaaaaagcttaacaagctttttagttaacaattaaaagtttctgtagaaaaacacaaattttctacagaaacttttaacattaaatcctctaaaactattgaattcactagattttacatgtacaatcattataatttcctgaataagaagtgtatccttaataaaagattaaattatacagtaaaaagtttaaggacttatttatagaagaggaaaaataagctttactatagattctagagtttttgttttaaagctacgtttattatgatcttctatggaaagaaatttacagtcattcatatcatttataaatatattttcgttgtatgaagttacatcagaatcataaataattgcattaatttcaaaattgagtttaaaacttctgatatctaaatttgcagtacctatactgcatatacatccatctgcacatattgttttagcatgaataaatccttttttatatctgtaaaattttattccgctttttataagtgtatctattgaggcacttaatgcataagccataaaaaaatgatcggcttcatctggaaccattattcttacatcaacacctgaagatgcagctaattttaatgccattatcataggctcatcaggaacaagataaggtgtttgaatatatatgtttttacgtgcattatttattatttttaaatatgagtttcttatatattcttcaagattgtcaggtccgcttgagattatttgtattccaactttgttgaatgtttttaaataatttgctggagtactgcttttacttgaatttatggtagaattaaatttattatttttgctcattaattcatttttatgttgtttaattgcatcaagaaataaatcacttaaaacataagcttcatcaacagaaggagtcaattttgtaagaacatattgtttttcatcaattgattcttttgcagcatattcccagtcaagagtaaaacgcttttgaagttcaagaactgcatcaccttttattcttaaatgagtatctcgccagaaatcaaactgttttcctttatttacatattcattacctacattaaatccacctacatatccagttcttccatcaattattactattttacgatggttcctataatttatacgtaagtttacaaaactaaaaatactaggaaagaaaaatgagaattttattcccagactttttatgtactgaatatttttcttttttaatgaacttgatcccataccatcaactaaaagccttacttcaacgccttctgaaacttttttaccaagaagatttaaaagttccattccaagatcatcacatctaaaaatataatattgtatgtttataaaggatactgcacctttgatatcatctattaaatctctaaatttatcttcaccatttatataagtttttacagaattattgtctgtatagacactgccatttgtattataattcatttttattaaatcaagacaatattgatcattttctgatgaatcataagtacttttaaatttatcaagaatatgttttaatttgtttttatcaatttttgcttttttactgaagattttttcctttgatatgttttgacctaaacatatatataaaataaaacctaagaatgggaaaatagcgagaactaaaagccatgcccaggttgtggttgaatcacgtctttcaataaagattagagaaacagcacaggaaatatctaataataaaagtatagccgttagtataatgtaaatgttcatgttatcaccacttttatgtttttattatatattttttctccattcatagactatttttgtctcaatattttagttttatactctttataaaaatttaatagttgtttacctatattagtaatatttaaattagtattataaaaattatcaattactacttttcaaatgtggaaaaacaatatataataaagaaaaggaaattaagtaataattattattaattattactagttactgattactttactaatacagaccttataataagatcgtataataaaaaatatacaaaagaaaatgaggtagacgcgatgagaaaaatgaaaacaatggacggtaatacagctgccgcttatatatcatatgcatttacagaagtagctgcaatttatcctataacaccatcttcaccaatggcagaacatgttgacgaatgggtggcaaaaggaactaaaaatatatttggacatccagttaaggttgtagaaatgcaatcagaagcaggagcagcaggagctgttcatggatcacttcaagctggtgttttaactacaacttatacagcatcacaaggattacttttaatgatgccaaatatgtacaagattgcaggagaaagacttcctggagttattcatgtagctgcaagagcacttgctacatcttcattaaatatctttggagatcaccaagacgttatgtcagcacgtgcaactggatatgcaatgcttgcagaaggttcagtacaggaagttatggatttagcacctgttgcacacttaactgcattaaaatgtagaatgccatttatgaacttctttgatggatttagaacttctcatgaggtacaaaaaatagaagttttagaatatgacgaattagctaagttagttgacaaagatgcactagaaaactttagaaataatgcgttaaatccaaatcatcctgtaacaagaggaacagcacaaaatcctgatatatacttccaaactagagaagctgttaacaaattctacgatgatattccacaagtagttgaagaatatatgagtgaaataacaaagcttacaggaagagaatatcattgtttcgattattatggagcagaagatgcagataaaataatcatagcaatgggatcagttacagacgtaattgaagaaactattgattacttaaatgctcatggagaaaagactggtttagttaaagtaagactttatagaccgttctcaatagaaagattattaaaggttatcccacaaagtgttaaaaagatagctgttttagatagaacaaaagaaccaggttcaattggtgaaccattatacttagatattttaagaagttacgctggaaaagctaatgcaccacaaataataggtggaagatttggtttaggttcaaaagatccaacaccatctcatattgcaggggtatttgctaacttagataaagaagaaccaaagaacggattcactataggtatagttgatgatgttactaacacttcattagaagttgttgaaattgatgctgcgaagccaggaacaactgcttgtaagttctggggactaggatcagatggtactgttggtgctaacaagaatgcaatcaaaataataggtgaccatactgatatgtatgctcaaggttacttccattacgattctaagaaatcaggtggtataactgtatctcacttaagattcggtaaagaacaaataaaatcaccatacttaattgataaagcagattttgttgcttgtcataatcaggcttatgtttacaagtataatgtattagctggattaaagaaaaatggtaaattcttattaaatacaatctggtcgccagaagaagtagaaagtaaattaccagcagaaatgaagagatacattgcagaaaatgaaattgaattctacacattaaatgctgttaagatagcacaggaaataggtcttggtggaagaatcaatatgataatgcaatctgcattcttcaagatagctgacataattccattagaagatgctgttaaatacttaaaagacgcagtagttaaatcatatgggaaaaaaggtgaaaaggttgttagcatgaaccatgatgcaattgacaccggtataaactcaattgttaaaattgaagttccttcttcatggaaagatgcaaaggatgaagttcacgaagcaaaagctgaatctaaagaaattccagcatttattaaagatatcgtagtaccaatgaacagacaagaaggagacagtattcctgtttcaacattcttaagagaaggtatggatgatggtacattcatgcatggtacttcggcatatgaaaagagaggggttgcagttaatgttccagaatgggattcatcaaaatgtatacaatgtaaccaatgtgcatttgtatgtcctcatgctgcaataagaccattcttattaaatgaagaagaagctaataatgctccagaaagtgttaaattagtaccagctaaagcattaaagagcgaagaaacattacaatacagcataggtgttacaccacttgactgtactggatgtggaaactgtgcacaggtttgtccagcaccaggtaaggctcttatcatgaagccacaaaatactcaagaagatcaaatcgaagcttgggattatgctgtggaaaaagttaagaacaagaatcctatgaacaaaaatactgttaagggaagtcaatttgaacaaccattacttgaatacagtggagcttgtgctggatgtggagaaactccatatgctaagcttgtaacacaattattcggtgatagaatgatgatagcaaatgctacaggatgttcatcaatatggggagcatcagcaccagcaagttcatacactaagaaccaagaaggacacggtccagcatgggcaaattcactatttgaagataatgctgaatttggtcttggaatgcagttcggtgttgaagcaataagggatagaattgaagctaatgctaagaaggcaattgaaactggtgtttctgaagatgcaaaagttgtattagaagattggatagaacataaaaattctggcgaagctacaagacaaagagcagaaagagttatggaagtgttagaaaatgaaaataacgaatttgctaaagctatcttagaagataaagatttcttaatgaagagatcacaatggatctttggaggagatggatgggcttacgacatcggatacggtggacttgaccacgttcttgcttcaggagaaaacgtaaatgtattggtatttgatacagaaatttactcaaatactggcggtcagtcttcaaagtctactccaacagctgcaatagctaagtttgctgcaagtggtaagaagactaagaagaaagatttaggtatgatggcaatgagctacggatatgtatatgttgctcaaatagctatgggagctgataaaaatcaagcacttaaggcaatagcagaagctgaaagctatgatggaccatcattaataattgcatatgctccatgtatcagccacggtattaaagttggtatggctaatactcaagctgtagaaaagagcgttgtagattgtggttactggaatctttatagatacaacccaacattaaaaggaactaagaatccatttactttagattctaaggaaccaaaaacaagttttagagacttcttaatgagtgaagttagatatgcatcacttgcaaaggcattccctgaagcagcagaagaattatttgctaaaacagaagctgatgcaatggaaagatatgcaacttataagagattagcaagtcaagaatagaatttaattgaccagttatagttgacagttaaagaggaactctattaggaagatttctagaaaataaaaattaaagaaacccttaggtttcctgtggaaactgtcaactgttacttgttaactataaaaagatgcctgatcataataaattagaaattttttagttattatttctgattaattatgacaggtatctttctttattctttgaaagaacccaaaaaaagttttaaaaactttgtatgagtaaaaaaattgatggttaatttttaagtgtaatctatacataattgttttttaaaatagttataatttgactatatattatctataaatagtagaagatttcatttacataatttctatgaagatttaatatatattaagtatgaattattagaatttagtcatataagaatctaataaggaatatttgatggaatattataaaatcaataatatgaatgaagtaaaagttttcataagaaatgattgaaaatatttttatttttagtatttattattatattattatactggatttctatttttaaacgaaaattgttgaaaatatagcatgcataccatataattaatattataatgacaataatttataagtcgaaatatgcgttataaaagagttggactttatagtaaagttatacaatcaggggtatagaagtatgaaagatactagaattttaatagttgatgattctccattccaaatcgcattattaagtgatgtactagaagaacaaggttttgaagtagtgggacaagctatgtctcttgaagaagtaaaaagtgaggttaagagaacaaaaccagatcttgttaccatggatttaacgataccaggaacagatgggtttgaatgtacaaaagctgtacatgatatcgatagcaatataaaagttatagttgtaagttcaatgatggatgaagaacttataaataaagctaaaaaacttggaataagtggttttattcaaaaacctgtagatactgaagaattgacacttcttattaatagggtaatggcagatgaagatttgttttgtgaattggaaattttatatttaggggcttatactgaggcaactttaaatatatttaacagattaacaaaaactgtacctgaaattactaatattagttttgaaaataaggaaaaaacaagtgcaggaatatctattgtacttggaataataggaaaatatagtggaagacttattatggacatgtctcttgagactgcagaaaagttttcagaatgccttcttagaagaaaggcaaaaaataacgaagaagttttaaatgttgtttcagaagtagcaaatatgcttgctggaaatggatgttcaataataaataagaaaaataaagtatttggtcttagagtagcacctccaacgacgatacatggagaatcaataaatatttctaaagctgaacttgaatgtaatttttcggctgatataaaaagtgaatttggggatatttcattaaatttaggtttcagaagaggtgaaagtgaatggatgtcagacatataaatccagtaatagaatcagtaggcaatataatgccacaattaggatttgctgaagtctcaaaaaagggagtaactttaaaagataggaatattcaaagtccaggtgtagttataataataggacttataggtgacgttaaaggaaatattatttatggattatctatagataatgcaaaaaagatagcttcacagatgatgatgggaatgcctgttgatgatttcaatgaaatggcacaaagtgcaatttcagaacttgtaaatatgcttacagcaaatgtagcaacaaatttttcgagagataacataacagtagatatatcaactcctacacttattcaaggagaatttacagctaatgcaagtactgataaagttgtttgtgttgagatggatgtagatggaataaatattcaaattaatatttctctatcttaagtatatttaagagcaaagcatagattgtgtctttgctctttttcatttataaaactaaaaaactttcctaagtgtatagtttattattatagataactatatacttaaggaaagtttttattatttatacttcttttcaagaagtaaaagtttttcttttaactgaataccaccaccatatccaacaaggcctccatttgtacctattacacgatgacatggtatgaagataaatattggatttctattatttgcacttcctacagcacgacaggctttttcattacctatactgatagcaacatctttatatgagcaggtagagccatatggaatttttaataaaacatcccaaaccttcttttgaaattccgttccctttggattaagagggagatcaaatgactttctaatacctttaaagtattcattaagctgtgtatgtgctttccttatcataggagattctataattctatcggctttaaaggatgaaataccaatgactgtttcaataataaaattatctttttcacatattgttattttcccaaagtctgtatcataagtaaatgaatttatcatcaataacaaactcctttcacaagtatgtagtaattataatattactacatactgatgtaaataatatatatttcaattatatattttaataaacattgtcctttaaactaaatatatatgctctaatatatattcttcatataatcttataaatcatgtaaggattttttcctaaattgtcaattcttaattggaacttatacatatttgtaataaattttaaattattaaacaatacaaattacaataaaatatcgtgattaaaaacatcaagatcaagttgtccacctattccaggaatatatccttcagaggtatactgatgtccggcttttgaattccaaacactatttccaggaagggagaatggagaatcattataatttgcttcccatagtgaatatgatgataagcttgagtcaaaattgtttataaagttagtataagtatatatgcaaacatccatattactcaattttttaaactcatttataaatcttacagtataatttaatgctgttgaagaacttacttcaacatccacacaaggtttaagatcattaggcttgtctttaatgcattgataaaaaagtcttgcttgatcttctggagagcttgtacctgttaagtagtgataaaatccaactttaagtccagcagccttagcattcttgcagtttccgtctgcatactgatctacaaagtaatcactttcagaagctttcatataaacagcttttataccagcttgtttaacagcgttaaagtctacatatccattatggttgcttatatctattcctttaaatacgctttcttgaattcctttatttttacttttataatcacattcttcagtgttgatatttatatttttatttgtaaaatataggtctatgtcaggttctgtttgatttgaaggaagaacaagttttccatttgaatcaagtgtatatccatcgatggctttatcagtgactttagcaccattgttatcaagatagaaaatatcttttccaatacctatccagccacttcttaaagcaccactcttattaaaataataatcttttccatcaattgtatgccaaccagtggacatgcttccgtcttcttttaaatagtattttaaattattagagatgaaccagccagttttcatggttccatcttcgttaaaataataccatttattattagataataacttccaaccagtgagcatatctccactattattgaatagatatgtattatctttatctttaactaatcctgtagccatgattccagactcatcaaggtagtactttttgttgtctatagtaatccatccagtctttttctcaccattactgtcagagtagtaccactttgtatcatctaaaatccatcctgtaagtaacttgccagaaggatcaaaatagtaccatttatcatctatattagtccagcctttagcttttttattatcatcagtgtaataatatttattgccatccgttgtattccagccttttaaattttttgctgaagtgttttcattttcttctttttgtaagctactattgttttcgtattgttgtaaatcaacagattgtcctaatgtttcgtgtgatgctgcgtaagatgctattggtaatccagcagttattattgtaatagcaactataacaagtttttttatactgttcactgttatgtctccttatttaatttaaatatttaatattcatttctgagtattatttcaattaaatattgtaacatatttacataataattataaaaatgtaataaaaatataataatttttctataacatgaggaacaatattgtagaatttgaataaagtatttattagacatattgataaaattcgatttgaagaatataatagaaatataagaaaaatatatgtgaggtgagaatttggaaaatagatacgaaatgaatgctaaagtttttaaagctttttgtgatgaaaatagattaatgataattgaaatgctacaaaatggagaaaagtgtgcatgtcatctattggaacaaatgaatataagtcaatctacattatcacatcacatgaaaatactttgtgaatcaggcattgttgtaagcagaaaagaaggaaaatggacctactattcaatcagctctgaaggaagcaaatatgcatgtcaactattaaaagagctaacacaaattatttctaataaaaagtgtgatgatagcagatgccatacataatttaaagccatcttttttagatggtttaaaaaatactttacatatcgaaaaaaatagatatgaattatatatgttggagtgataaaaatgaaaaaaatgattatttttgacccagctatgtgctgttcaacaggggtatgtggtccatctgtaaatcctgaattattaagagttgctacaactattaatgttttaaaaaacaaaggagtaattatagagcgatataacctatctcaaaatccgcaggctttcattgataataaaacaatcagcgatatattaaattctaatggagttaaggtactgcctgtaactatggtagatggtattgttgtaaagtatggaagttatcctacaaatgaagaattctgttcattgcttggtataccagcagaatttttaaaaagcaatataaaaatcaaaagaagtggaaagtgtaattgcaaaggaggatgctgttaaattaattgatataaatacaatgcccaatgattacttttgaaaagagatgaaaaaatatgttcaataaatttaatatagataatattaatttgacaaagtatttattttttacaggaaaaggtggtgttggcaaaacttcaacagcatgtgcagtagcattaaacctaagtgatagtgggaaaaatataatgcttgtaagtactgatcctgcatctaatttacaggatgtatttaatactaatttaaataataaaggtacaaaaataaaagaaacacctaatcttacagtagcaaactttgaaccagagcaggcagcaaaggaatatagagatagtgtaattgatccttatagaggtaaatttccagaaagcgtattgaaaaatatggaagagcaactttcaggatcatgtaccatagaaattgctgcatttaatgaatttgcaggaatgataactaattctgacgtggaagataaatatgattatattatatttgatacagcaccaacaggccatactttaagaatgcttcagttaccatcagcatggagtagttttattactgaaagtaaacatggagcatcttgtttaggacagcttgcagggcttgaaagtaaaaagtcaatgtataaacaagctgttgagactctagctgataaagataaaactacccttattttggtatcgcgtccagagtatacacctttaaaagaggcagatagagcatcgtttgagttaagtgaattaggaattaaaaaccaaatgcttattattaatggagtaatgcaggaacatgacgatgagatatcaaatgcaatttataataaacagcataaagcattaaatgaaattccacaaggattaaagaatattgaaacatttgaaattccattaagaccgtataatataactggtttagaaaatgttagggcattattgaaagaagatcatgtacaatattcacaagaagtattaaaagtatcatcaataaagaaacttaatgatattgtagatgatatttatgataataataaaaaagtcatattcacaatgggaaaaggtggagtaggtaaaacaacagtagcagcagccattgcaataggtttagctaagaagggaaaaagagttcatttgactactactgatcctgcaggacatttaaaatatgtattagatgaaagttatgggataacattaagcaatatagatgaaaaagaagaactagaaaagtacaaaaatgaagttttaaataaagcactgaagaataatatgaccgaggaagatattgaatatatagaagaagatttaagatctccgtgcactcaggaaatagcagtatttagagcttttgcagatattgttaaaaagtcagatgatgaaattgtagtaatagatacagcacccacaggacatacattattattattagaatcaactgaaaattataatagagaaatttcaagaagtgaaggagatattcctcaatcagttattgaattacttccaaaattaaaagataatagtatgacagaagtggtaattgtaacacttccagaagcaacaccagtatatgaagcagtaaggcttaaagcggatttagacagagcgcagatttataataaatggtgggtgattaattcaagtttgtataaagctggtgttacaaataaaatattaaaagtaaaagcattaaatgaagtaaagtggataaataaagtaaatgaagtatcacgagaaagatttgcaataatagattggaaatcagaagaagttaaaggtgataatctcattggtttattaaaataaaaaaaataacattatgttaagaaaggttgataaacatgaagaaaaaagtagcatttatctgcgttcataattcttgcagatcacaaatggcagaggcacttggtaaaatttttggaggagatgtttttgaaagttattcagctggaactgaaactaaaccagaaattaatcaagatgcagtaagaataataaaagatttatataaggtgaatatgaacgaaactcaaaaatcaaaattgctgacagatataccaaagatagatatagcaataaaaatggggtgtaatgtagtatgtccctatttgccagcaaagcatacagaagattggggacttgatgatcctacaggaaaaagtgatgaagaatttataaaaacagctaaagtcattgaagaaaaaattaaagaccttgctttaagaataaaaaataatgaattgtaaataagtttataatgcggctctactaataaatgtagagtttgtatatagttattgaaaagaggagaaatatttatgttggagaataaaggaagaggattgggcatatttgaaaaatacttaacattatgggtagcaacatgtatagtaataggaattgcagtaggaaagtatttacctataatacctgatactctaaataagtttgaatactataacgtatcaataccagtggcaattttaatttggcttatgatatatccgatgatgcttaagattgactttacaagtatagtaaatgctactaaaaaacctaaaggacttatattaacttgcataactaactggattataaaaccatttactatgtatgcaatcagtgcatttttcctttttgtagtgtttaaaaatttaataccatcagaccttgcaagagattatttagcaggagcagtgcttttaggtgcagcaccatgtactgcaatggtatttgtgtggagctatttaaccaaaggagatccagcctatactttagttcaagttgctgttaatgatttgataattttaatagcttttgcaccaatagtagcatttttgcttggagtttctaatgtgaaagtaccaatagaaactttgattctttcaacagtattatttgtggttataccgttaggattaggttatttaacaagatgcataatcacaaagaaaaagggcgcagattactttaacaatatattcttaaaaaaattcgataatattacaataataggtctgcttttaactttaataattttattttcattccaaggagatattattttaaaaaatccactacacatcctattaattgcagtgcctcttacaatccaaacattttttatatttacaatagcttattttggagctaaattattaaagttacctcacaatatcgcagcgccagcaggaatgattggagctagcaatttttttgaactttctgttgcagtagccatatctttatttggccttgaaagtggagcagcaacagctacagtagtaggtgttcttgtggaagttcctgtaatgcttgcacttgttaagatagcaaataatactagaggatggtttaaaagtaattgaagagtatagtatgttagtttatagagaaaactaatagtggtttacaagagataataattttatgacttcacatgtaaaactcaatatttaataaaaaattatattaaaaaggagaattagtattatgaaatattatcttatgacttatagtgcagaaatcagatatagtggaaacagagtttattttagtaaagctatagatactgatccaattgattactttattagaatgaaagaggaagaaggcaagcagaagttaagccattatacagagtttgcaataaactttgtaagtgaaataagtaaggaacaatattcaaaattagcagataattaaagtaattaaagcgatagactattgtttttagtttatcgctttataggattttataaaaaataggagacaatatgaaaaaaatagatttaactaaagggagagtcatttcagttatagctgcacttgcacttccaattatgggaagttcattacttcagttcacttataatttaattgatatgatatgggtaggaaagcttgggagtaatgcagttgcaagcataggttcatcaagtttatatgttaatataggaaatgcaataaatgcattagttgttattggaacaggaataaaagtagcccatgcaattgggagaaaagataatgatgaagtaaacaaatatattaattctggaataataattaatcttattatgggaattatttttggcatagtactaatttttgcaggtaaaggtttcataggttttttaggattaaataattctgaagttgaaaaaaatgcatattattatttagcattgaatgcacctattttattttttgcttttttcaatatgatgtatacaagaatcctgggtagttttggaaataacaaacttgcatttaaaattaatggagtaggtgtaattttaaatataattcttgatcctgtgtgtatttacatttttaacttaggggtaataggagctggaattagtacacttattgctaatataataatgtttatcttgttcagaataaaatcaaatggaattttaaaatataaatttggtaaaggaatagattatattaaaataaaagaaatttgtattttgggatttccaatggcgtttcaaagagttttatttacaataataaatatattcttagctaagataattgcaatatttggttcagatgcaatagcagcacaaaaagtaggagttcagatagaatcaatagcatatatggttattggaggattaaatggagccgttgcaagctttacaggacagaattttggagcaaagagattcgatagaataaaagaaggatataaaagttctttaaaagtaggaatagcatatgcattagctatggcaggtatattttttatctttaataggccaataattaaattatttataagtgatgaagaaaccattgccatagcagcatcatatttacaagcagtagccttttctcaagcattcagcgcaatagaaatgatatctaatggatttttcactggaattggaaaacctaatattccagcagcaataagtattatatttacaagtttaagaattccatttgcactggttttaattaagcctttcggaataaatggaatatggataagcatttgtttatcaagtattcttaaaggactttctgcatatttattatataaaattgaacttaggaaagaaaacttctcaattaattatatagagagttgaaaatgatagattctaaatgaatctatcattttttagggtataaattaaataatgacataaaaatatttagtgaaagtatgataaaatcttattttgtgttaaacttactaatgaaagataaagcttattatgataacaaagataggattagtaataataagtttaaaaaaagtcttggaaaatagaaaaagaaaggtggtttgccttaaaatggggaagtcattaatacttgcagaaaagccttcagtaggcagagatttagcaaaagttttaaaatgtaatgtaaataaaggttcatatattgaaggaaataaatatatagtaacttgggcaatgggacatttagttgggcttatggacccagaaggatatgataataaatataaggaatggaaaatggaaactcttccaatgcttccaaagcacatgaagcttactgttttaaagaaaactggtaaacaatataatgaagtaaaaaaacagttattaagaaatgatgtaaatgaaatcatcattgcaacagacgctggtagagaaggtgaattagttgccagatggattatagaaaaagcaggggtaaaaaagccattaaaaagattatggatttcatctcaaactaataaggcaattttagatggatttaaaaatttaaaagatgctaaagaatatgaaaatttatataaagcagctgtatgtagagcagaagcagactggcttgttggacttaatgtaactcgtgcattaacatgtaaacataatgcacagcttagtgcaggaagagttcagtcaccaactcttgcaatgatagttcaaagagaagaagaaattagaaattttaaaccagtagattattggtgcttaaatgctaaaactgatagattcatgttaaactgggtaaatgaaaaaggaaataattcaacttttaaagaagaaattgcagactctatagtaaataagtgcaaaggacaaaatggagaagtattagaagttaaaaagacaactaagaaaaagtactcaccagcactttatgatttaacagaactacaaagagatgcaaataagatttgggatattcagcaaagcagacattaaatttaatgcagagactttatgaaaaccacaaggttttaacttatccaagaactgattctaggtatgtaacatcagatatcgttgcaactattcctgaaagattaaaagctgtatcctttggagaatatagagtggcagcacaacagattttaaatacagggttaaggctaacaagaattatgttgataattcaaaggtttctgaccatcacgctattatacctacagaagaaaaaggaagccttgctaatttaagcagtgatgagaagcatatttatgatcttgttgttaagaggtttttaagtgtattacttcctgcttacgaatatgagcagactacagtaacagtaaatataggaaaagaaacattttcagctaagggtaatataacaaaaagcaaaggctggaagatgctttatgataatttaaatgatgatgaagattcgcaagaattaccacatttaaataaaggtgataatataattataaaatcagtaaacaaggtgaaaaaacaaacaacaccacctgcaaggttcaatgaagcaacacttctatcagctatggaaagcccacagaagtacataaatatagaaaaagatgctgctaaaactttaaatgaaacaggcggacttggaacagttgcaacaagagcagatataattgaaaaattattcaactcttttgttattgagaaaaaaggaaaagatatttatcctacatcaaaaggaaaacagttaatagaacttgtacctaaggatttaaagtcaccacttttaacagctaaatgggaaagccagttagatcagatagctaaaggaaagagagataatttatcatttataaaagaaatgaaaaattattctgtagcattagttgaagatgttaagtgtggaagcagtaaatttactcatgataatttaactggaaagaaatgtccagagtgtggaaaatacatgcttgaagtaaaaactaagaatggtgtcatgaatgtatgtcaagacagatcttgtggacatagagaaagtgtatcaagaactacaaattcaagatgtccagaatgtaagaagaggcttgaacttagaggacatggtgatggaaagatatatgtatgtccaggaacaaactgtaacttcagagaaaaagcttctgtatttgaaaagagatttgataaaaagggcaaagtagataaaagagaagtaaataagataatgaacaagatgaaaaaagaagcagagcaggaagctatgagtgataatccatttgcagctttacttggaaacatgaaatttgatgataaataaattataattttatataaaaagaataaaatctattttaggaatagaaataaaaacaggaaatcaaaaaagtgatttcctgtttttgattaaaaatatatttttagatttaagtaggtgttatttatttaaaatataattattaattccataagcaaccccatcttcagaaacagacttggtaattttatctccatgatcctttatttcatctaaagcatttcccattacaattccacaacctacagcattaagcatttcaatatcattatgactatctccaaaagcaaagcttgagtttatatcaatgttaaaatgatcaagtattctcattattccagatgcttttgtatcttttcttgaatataattcaaatagtttaaaatcatcaaaatatgtatatctaaaattatcatcctccagtgttttgcagaaattgtaagcttcttcatctagacagtgcatttcaattttgcaggcattgatattttcaatatcatattcatgttttatatatttcatggatatgtcaatgcgttcataaaaagctttctgagttttaaaatcatttttaagataagagtatttttcatcctcaagaatatattccatattataattttcaaatttacaaatgagttcttttaaatgttcttttttgatattatttttataaaaaggttttaaattgttagatttattatcatttaataaaattaaagatccattcatcaatatgtatccatcaaatccaaaagtcaggatatcttcatttaaaaatgcataaggtcgtccacttgatacaaagactaaaatatcgttattttgaagttcacgtatagcatcttttacaggtgaagttattttactcacccctttagaagtatctaaaagtgtaccatcaatatcaaaaaatactgcttttttcattattatatttcctccatatgacttgttattgtatttagtaacaattgataatattgttttgttatcacttattactattttatttaattatattaccatttagtattaatttcaacgttatttcttgaataataatataaaaattgatacaataagaataaataggagggattcatatgtttattgaagaaagacataaatgtattttagaatcattagaacaagatggaaagatatttgtaaaagatttaagtgaaagatttaatgttagcgaaagcatgataagaaaagatcttcaagcattggaaaaacagaatatgcttaagagaacttatggtggagcaatacaaataacaagacagattgttaatgaagtgagttatttaaagagaatccacacagatattaatttgaaagaaaaagtagcgttaaaagcttatgaaatgataaatgacaatgatactatatttcttgatgcatcaagcatatcttattgcatagcaaagttaattgcatcgagcaataaaaaagttacaataattacaaatatgatagtactttcatcaatagttgaatgtactgataatataaatgttatctatattggtggaaattataattctatagtaggaggaacaataggctctcatgccataaattcaataaaaaattatcactgtaataaggcttttattggatgtggaggcgtaaatgctcaaaatggaaacttaagtacatctattggtgaagatgcaaataccaaaagggttattatggatatttcaaaagaatcttatcttttagtattaaatcagagatttaatattgatgctgtatataattttggaaaactttcagaagttgattcagtaataacagaagatatgccagagagtagtattatgaatgagcttaaaaaatataatgtaaatattatttaatattatatgtgttaaataaaactactgaaagaaatcattgaagtatggaaatactaaagtttaatgacttttttcaaaaagtatgctgaatcatattaatttaaaagaattaatatgattcagcttttttaatacaattaataagcgggatatttcattatattaagtattaataatttaatgtgactaagttacagaagaactatttaatattaaatataattaatacatagacaaatttgattttaagattttctagtataaaaagaaaatttaaactaactataaatattgtgaaatttagagagaaaacaaggaggaacaaaaaatgtttggactttttaaaagagatataggaaaagtgattaatgtaaatgatattgataatttacttggaaagattgaacttattgatataagggagaattatgaatataaaggtggaagtattaaatcggcaaagaatattccaatgggaaatcttttagataatcctgaaaaatatttaaataagaataaagaatattatattatctgccagtctggtgggagaagtgcaagagcttgttcattccttaaaaagcaagggtatgatgttataaatgtatcaggcggagttggatcatacgcaggttcacaaagaaaataattgtaaagttaatagtgcaacatatagattaagattagatataaattaaattatacaaaaaaacgttcgaaacccttgatatatcaataaaaaattaaaatcgtagtgtaaataattttacactatcattagaaaatgggaggaataattatgaagaagaaaatacttataataggtggagtcgcaggaggagcatcagcagctgcaagacttagaagaaacagcgaagaagatgaaattataatgtttgaaaagggtcctcatgtatcattttcaaactgtgcactgccataccatttaagtggtgtaattaagacacctgacagactagtacttatgagtcctgaaaaatttaagaaacagtttaacattgatgcaagaacaaatagtgaagtaatttcaatagatagaaaaaataagactgtagaaataagaaagactgatagtgatgaaatatacaaagaaagttatgataagttaatattatcaccaggtgctcatcctatagttcctaaatttgaaggaagtgatgaagttagcttgtttaccataagaaatgttgttgatatagataaaatcaaccagtatttaaaaaataataatattaaagatgtagcagttatcggtggtggatttattggagtagaagcggcagaaaatttacaagatggtggttataatgtatcacttgtagaagctggaaatcagatattaagaccttttgattatgatatggtacagatacttcataaagagatttatgataaaggaatagatttaatagtagaagataaggttgaaaaatttgaaaaagatacggttgttttatcatctggaagaaaagttagagcacaagcagtaataatggcaataggtgtagcaccagaaacaaaacttgcagaagattcagatattgagctaggtgaaacaagggcaataaaagtagatagtaattataaaacaaatgatgaagatatatatgctgttggtgatgccatagaagtatataattcccttactcattcttatacaaagttatcacttgcaggtccagcccagaagcaggcaagaaatgttgcggatcacattaataataagaatactttgaatagaggatacattggttcgtctgcaataaaggtttttgattataatggggcatcaactggattaaatgaaagtcttataaaagctttgaatatgaatatacaatatgatgttgtaagattaatacttagtgataaggttggaataatgcctgactcatcaccaatacactttaagatgctttatgaagtaccaacaggtaaaattttaggtgcacaagccattggaaaaggtgatgttacaaagagaattgatataattgctacagctataaaatttggtggaaatgttgaagatttaaaagatttagaactttgctatgcaccgccattttcaactgctaaggatgttgtgaattatgctggatatgtttcatgtaatttattaaatggtgactttagacaggtaaatgttgataaagtacgtgaacttgttgaaaataacgcatatataattgatgtacgtgaaaagaatgaatatgacaatggacatattataaatgcagtgaatatccctttaagtgaactaagagacagaataagtgagataccaaaagatattccagtatacttacattgtagaacagggcagagaagctacaatgcagcaaaagcacttgggaatttaggatttcagaatatttataatattacaggaagtttcttaggactatctttttacgaatattataatgataaaagaacaggaagagaaagcatagttacagaatataactttagataaagtttatataaaacctgactgaacacttattgtgcattaagtcaggttttaattttatattcttatataactttgaagatttaagaggcttttcataaatattactttgattgcattttaacttaagtttatttattgaaacatatagtccaagaacataggaaatcttctcttccaagattcttctgaatgatttgcaccttcatctataaataaaaataaatcttttttatcttgtcctaaattcagaaacaagtttgcaatttccttagtgtcgttaagataaatattgttaaaatctttgttattatcatcagacgtttcttttgttccaatatctaaataaactttagtgccttctttaaagttttcctttaaaaattctataagactatcttttttaaaccaggcagccgtagaaaatgcaccaatgccagagaaaacatcattgtatttatatcctgcatataaagatataaatgcacccatagatgagccagctataaatgtattatttctatcaggcaatgttctatattttttatcaatataaggctttagaaattttactataaaatctatataaagttcaccttcaccaccaccagtactgatatttctagtaggtagcatttcagtaagattttcatttatccatggagaatattcatcaaatcttccaccatcttgattgcagtctatcccaacgactatgataccatctcttccttcagattcccatttattcatagcagattgaatatcccatattccaccaaatgctgaagtttccttataaaataaattatgtccatcatgcatgtatataactttatagcgcttatttatagaagtactataatcagatggtaagtaaactcttatcattctttttcgatgtaatgtgttaatttctagttcaaaattctcaatattatacattaaaatatcctcctcattaaatatatatataagtgtagcatatattcatatgataaaaaattgtaataatgtataaatattatgtatatttaaataatagtacaataatatagatttcacatttgtaaatataaatagatattcaaataattaataaaaccttgaaaatttttaaagaataactgttaattatatattgtaaggaggttatgggaagaataataaaaaatattattaatattaaaaaaattcatgtactaaggaggaagtttatgtttttaagaaaatctataatcggtattttatcactatcaatgattatgagtacaacttttatagcatgcagcaatagacaagaaaatattaatatatcagaaggggaaatacaatcacttaatattgaaaaaactgtagaaaataaatacgaagcagaaatttcagaatttgagtttggtgattatacatacacatcttcaggggacgtactatgccctataacataagaggaagaattgccgtaccaaaaggagaaggtaaatttccagttgtatttataacacacggctcacatgaaaatatagatgaatcaaagaggtttgatacaggatttgattatcttataaaaagtcttgcagagaatggatatgtggcagtatctatggatatgagcaaggcatatatatggaaatatggagataatgatgatactgaaaagagtatcccaatggctgaaaagcatattgaaatgctaaagaacgcaaatgaaggtaaaaatccaggatatagcattgatttaacaaataaaattaattttgatgatttgtgtcttgcagggcactcaagaggggattagcagtaattgaaatagcaaataatgagatacgtaagggtaataatgtaaagggagttttattgatagcacctacattaaatgaggatataaaagttggagaatacgatatttcaataatagttccccagtatgatggagatgttgcaagccttgaaggatatggaatatatgattccttaaaaaaagaagatagaaattatcttgcatcagtgacacttcttgaaagagcaaaccataactattttaacagaaatattgtgagaaatgatgcagaatttgtaatggataagtattcaaaagaacaattgacaagagaagagcaagaagattttttacaaaattttgctgtagatttttttaatacatcactaagcaaaaatttgaaaaatactatgtatgatcttgaacagccacagcctaataaaatgtatggatatgatgtaaaagttgaaacaataagtggaaaagttacacagcttgtggatatgaaaaatatagagaatgttagttcagaaggttcagtaatagaagcaactgtagattcatggttttttaaagatgataagactttaatagacacacttacatttggaaatggagaattaaaaataaaacccttattaaatgtaaaatggacatcagaaaatgatactgtaactataaaaccaaaaacaagtgattttactagtagcaaaagcattataataaacttagcagtagatagtgcagatgaacttaatgaaaagaacaagtcgcaatcattcacagtacagcttaaggataagaagcaaaagatatcaaatatatcacttcctgaaggtattaatgctttaaaatattacgacggtgagataggagtaacacctcttgataatgaagaaataaagtattggaccacaaaaattccattgggagaagtgagaataccattaaaggattttcagaatatagatttaagtaacatagacgaagtatcatttctctttaacaagactttaagtggcggtatattaattgagtctattcagttacaataataaatagtaaatataaatgaagcatagcagaaatgttatgcttcatttatatttatgtcacaatagtattgaataatattatcaattgataatacatacgttttttatttatatacaattttacaagtataatcttgaaataaaaaaatatactcaatatatacagagtataggagttatattttttattcttactaaaaatagttcacaaacatatagattaatgaatatattacttttaataacataaactcaattgagaatataggaggcacaaaaattggaagataatagattaaaaattggagtaagggtaagtataaataccatcataggaaatttagttctttctataattaaagtattttgtggaatagtagcaactagtgcagcaatgattgcagacggtattcattcactttcagatgtattcacaaccataggtgtaataataggattaaaactttctagcaaaaaagctgataaagagcatccttatggtcatgaaagaattgaaagcataacagctttatttttatcaattgtattatttatagtagcacttggaattggatattcaggaattgagaacataataaataaaaattatagagtaccaggatttcttgctatagtggctgctataatttcaattttatctaaagaagccatgtattattatacactaatatatgctaagaaaattaacagtacatctttaaaagcagatgcgtggcatcacagatcagattcattatcatcaataggagctttaataggaattataggagcacgaatggggtatccggttttagatccattagttgcaatagtaatttgtataatcataataaaaatatcttatgatatatgcaagcagagtgtaaatcagcttatagatgcatcagctagtgatgaaaaggtaaagacaataagacgaaagataattaatactaagggtgttataaagattgataatcttaaaacacgtcagtatgcaagtaaattatatgttgatgtagatatttcagttgattctgaaatgtcagttgaagagggccatagcattgcaatgaaagttcatcagtatatagaagaagataaagaaataaaacattgtatggttcacgtgaatccatatattgtacatgggaataattcatatcaatagaaatgttatagaaaaatatgttggaatcttgattattttaaaataattaatgttactataataattatgtgatattgtataattagtaaatttatttaagaaatggggacgttttaaatgaacaaaggtttaaaaataagtaaaccaaaatttgtagatgattttgaagatatagaagatttttatgatgaaatagtactaagtgataaaataatgaataaaatagttgatagtgaaataatagaaggtaaagaagaaaaaggtatgaatattgattcttgcatttttagaaatgtggtatttaataattgtatttttaaaaatatagatattattgatactgtatttgaaaactgcgatttatcaaatatagattttggaaatggaagcatagaaagagttgaatttataaattgcaagcttttgggtgcaaagtttgatgaatgtatgatgaaagatgtattatttaaagacagccttggtaaatattcaaacttttctttttcaagattaaataaagtatacatgaatggatgtaattttgaagaaggagtttttcaagaagtaagcattaataaaataatgtttgataatacaaatttattaaatggagtattttataatacaagtttaaaaaatattgatcttacaacctgtgaaattgcaggaataagcgttggattaaatgatataaaaggtgctaaggttacagcaattcaaggactagaacttacaagattgttagagattataatagaataaaaaataggtttcgttcttaatataaatttttaaatttcagagctctaaatcgtaattaatgagtaataaaattctctttagttacgattttttttgtgaaattaaatttataaaaatataattgaataaaattaaaaaatatattgacaaataatcattattgattaataataattataagagttgggtaattattattaactcagatatgatttatatgttgaatcaaactaattgcaaggtataaagttataatctctcaagttctgagtaataataattctctcaactgattacctatataaattatcttaataagaaactaagaaagtgtgtctaggaggaactaataatgaaagcatttgtggatgaaaatacatgtatatgttgtggattatgtgaaggaatatgctcagaggtatttactaccgatactggagttgcagttgcaggtgaagtaagtgcagataatgaagaaaatgtaagagaagcttgtgacagctgtccagttgcagctatttcaatagaagaataaaaatattatttaatattaaattttagaacgtgtatgttaagaaaaaatataattgtaaaaggagaaacggtatgggaaatatttgtttatgtaaaaaagtttctgaagaagaaattgtaaaagcagttaaagatggtgcaaaaacttttgaggaagttaaagaagcaactagtgctggatcaggatgttgcaaaggtggaagatgtaaatcaaaaataatagagataatagaaaataactaatttaaaaaatttattaataactttaaatttttaatttaccccaattaattaatcttatttcaaatttaaatattcttaaaaataacaagaaatgtgctagagtatacttattatgctttagcacatttttatttaaataaataagacagataaattagtttattgtttaaataatatttttgtatatatgtagattaggatgtgtcaataaaaataaggattacatactataaaaagatattcaaattatatataatttgatgaatacttaaagtttataggagaaaaaatggcatttttattaaagcatgttgataaaacaacagttaattacgatacgtcttttacttatacaattgaagctagctttaatggacttacacttccagaaattaatccagccattcttgtagatacagttccatcctatattgaactagatttttctgcattagatccggatataacttataatgtgcagactgtaggtttgaataatgttattactttttattttccagaaataactgaaacaggtattgcctatgaaatagatttgaaatgtaaatttaaagatggaacattaaatggaagtacttgtactaataacgcacagctatatttagcaggatcagatacaccatcttttacttcatctgcgccaactgtaacattaagcattaaagctcaatgggatatagaaaaattaatgacctccccagtaaacaataatccaactccaggagggtatgcatactactctatatttttgaaaaatttaggtgatagaggagcagcacttaataattttacaattaaggatacacttccagctggtatgactttagatccaatatttgtacctgttgtaacgaatcaaggtggaggtattttaaatcccaacccaccaacttacgtgaaagatccaggagataccggtattacttggagcataactcagtatacaggtaataatctattatttattattaaggtaaatatagataagaatgtggctttaaatactgatcttactaataatgttaagcttattgattctgaaggaaatgtacttgattactcaaatcagacatctaaagttacgtctcttcttccaatgacaggaataagcaagtatggccctaaccatagttatgctggagctttaataagctatgaaatatatattcaaaacaatggtaatactgctcttacaaatcttgttgctatagacacaattccagccaatgttacaatagaaaaagtctttccaggaaactttgctataagaggattaggaacatttccagctaagacatttcatttatactatacaacagatgattatagtgtagtaaatccttcatggacagaaataggagtaggatttccatatggatataatccttattggacatattacaatcttccaacaacacctaataaggttacaagacttaaatgggagttcccagatgctgatatagattttactcaaagtgacgcacctcgtttaaatggagtagttgcttcaaatgcaaaaactacagatactgcagttaatgttgttaattattatgctgatcaaatttcaccagcacagactgattttacaacttatttagatggcattgcagaaattaacggttcaaaatataatcatcctagtggaagtgtaattcctacagatacaataaattatgagggatttataaatgcatgggcatccccagtagtaaatcctataatagttgatttgcttcctatagaagttcagtattcaggaaatgtatctgtttattatgcagaatattttactaatcaatgggtatggacaaaactaaatcctatttcaggaagtggaccacagattattgtaacaagtgaagaaaattataataatactggaagaacaagagtgaaaattgagataaaaccttttgttttgacacagagaagtttaatgagtataagctttgacacaactgttaaaccaggagtaacaaatacaattcaaaataatatgctcataggaaatgaagggaaatctatagcttatccatcttatcttgacacaacagaccaagatggtgatggaataaccaatgaacagcttttaattactaatacagtatataataatgtattgttttctactaaatatgcatctgataaaaaagtaaagggagcacttgacacaaactatactcaatggcctgatgttggaaatacttataatggaggtccggcattatataggctttcatttataaatataagtaatacaaattatagaaatattgaaatggttgatatattacctcatattggagatacaggagtaatactaactaatactagccgtggatcagaatttcctgtatatcttggtcagaatattgcagctgaacttactcctccatatcaaggagatccttcacctacaatagaaatatggtactctgaaagttacaatccagaaagatttagtgaaagtggaggtataataccaggagataatgattggacacagacagcaccatcaccaattaccaaagtaaaatcttttaaaataataacaacaggtgaaacaataataagacctggacagacactaaatatatatgttgactgtgtagtaccgttaggcgtaaatgaaggacttaaaggttggaattcatttgctttaaggggaacttttacagatgaagatggaaaagatgcaaaacttcttcctgttgaacctgaaaaagttggaatacaagtaaagcttcctggaaaagacactgtaactttaggtgactttgtatggattgatgaaaatcatgatggtatatatgataatggagaagtaggtataaatggagctgtcataaatttatacgattctaataaagtttttatttcaacaactacaacaacttacgattcaaataataatcctggatattattcatttaagaatattgacccaggtgagtattatattgaatttataccaccagatggttatgttttaacagtgcaaaaagctaatgaacaaaatggaagcaagccagatcgtacaactggatttactaaccttataacaacagtaacaactcctggttcaatagatatgacaattgatgcaggtgtttatccaagtaatttactatcatctgtaggtgattttgtatggattgattcaaatagaaatggtgtgtacgaccccggagaaaaaggtcaggctggtgttgttgtaaccttatatgatgaaaatggagtaagaacagattattctgcaattacagattctaatggaaagtatttaatagataaggtaataccacaaaaatactatgctgttttttcaaatatacctcaggattatttatttgttactgcgaaaggatatgtaacaaacacaggagttactccaaagattatagatgttccatcaggaacatttgttgatactgttgatgcaccaatagcatttaatgatggactaatagggcctccagggcttccaggaccttcaggatgttgttatacgtacaacaacctaaatagtatttatctagataatcaggaagttaaaagaggatgtaccgttaatttaggatgtagtgcagttaataatggtgagtttagttcttatgagaataatagtaattatgtaattttaaatggagaaggaacatttatgattgattactcctgttatggggaatttttagaaactccaaatgagaaagattatattgcacttcagcttaaactaaataatgattttatccttcaaggatattcttatactactgaaaatggagttttacagggagaagctttagtaaataccactggattatgtggtactaatataaaaaatattttgaggttggtcaatgtaagtacaggggatataagaataaataatctaaactttaatattataagaataaattagatatttgtaataagttaaggcagataatatagaacattttatctgcctttaaaatataataaaatgagagtttttaaatttggagatataaaataatgttttacaataaatcagaagattcaaaaactggtaaaaaattaaaatatataataaaagatattaaagataatgcaggtcaattaaatcgtggaacgaatatatctatttctggaaaagtatttattgatttcaatagaaatggaagtattgatcctatggcccaaggtgtagataaagtggtaataaaattatatactgaagatggacaatctactgaatacactacaataacaggagctgacggaacatacattttaaaagatattccatcaggaaattattatttaattgttagtaatataccaaataatatgatctttattgaaaatgtacttgttaatccgcatataactaaaactggtatatcaaacgagattattaatagtaatattgaaaatttcaatattccaatagcagataatttagaatctagaggtatgcaaggcattactggtcaaaagggctcagattcagactgtgcaactttttattctatggaatttgactgtcagacagttccaaaaggagattacattgaactgggtaataggatgtctggaaatagatatgtaatagattataataatggtacatgttttgtaaaattaaatagtggaggagtatattttataactttagaaggtcatgcagattttattggtgatacttcaattgaagattatataggaatacaattaaaattaaatgaatatcctttaaatcaggggttgttttataggaaagataatggaactatttatatttctactcttgttagagttgagccttttaaaaacaactatataagttttcaaaatacaggtacaacagatataaatgtagataatataagtcttagaatatggaaaatatcctgaaaaatactccaccataaagcatataatcaataaaagattgtgctttatggtggagtttattatttttaatttatagctaatctaatggctctatggttatagttgatattacatccattaccttctgaatgttttcgcatataatatttagtctttcattaatagaattaatctcagaagtatctgaaggaacactattgtcatttttagcagaataagatgttaatatggtatccttaagttcattgaaatcagattgtaataattcaaggttttgagaaacaggtataacaacattttttaatttttcaacttctttatttaaatctaaaaagttattagaaagaagtgtagaattgttttcaaataaatcaagctttttatttatagcttcaaaacttgagagtttagcatcgaatttttctaatgattgtgttattgacttgtagtatgattcatttaatttagtataggatttaaattctacgctactattatcaagattattttgaagataaatcaaattttcttttaaagctgaaacatcatcagaattgcatagctttgaaaagttttcattaatagatgatattatactattttgagataaaaatgaatttgtaatagatgaagttataagttcttcaaggtttcctatttcaatatttttggaacatatatcctttaaagatgaaataagtgatgaattatccttcatttgattaataaaatcagattttaatatagaaacagtattattaagttcatcaacattactattattgttatctatcaatttatttaaattaataattaaagcatttgtattttctatatcattttttgaaataataccagtaaatttatattttatatcttcaagctgtgagttttgttcattaatggtattttgaatattagaaataagtttatttatatcatcgatattttcacatgttggaatatttaaagcagtttcttttatggaatttgctatttcatataaagaatcaatatttcctgataaattagaaataaaattattagtagaattcaaatcatcagttgaacatgttcgtcctaaagtttcatttatgctatttattaaagatgtttgattactgaaaattgtattaagttcagttatggaagaatttatatcagatgcatcagttttagtacatgtgttttcaataaattcttttaaagaagatatatccgagttttgaatttcaagagagcttactagtagtgtcataattgaatttaatgcagttatttcttcagatgttgaatttgcagatgatatttcttttatttcatttaaaatcgtatataatgattctatattatcagataaggttaaaataagatcatttgttttttctatatcttcagttaaagaattatcagatgttattacctttatagaattaattatcgaagtttgtgattcaagtttttgatttaatttttcaatcattgtatttgtaagaacaatatcttttgaagaagatttagttgagagttcattataaagatttaaaatttcttcattaacactattgagtttaccagaaatatttgaaaacatattgtcaaaatcttctttgttatcaggaattttcaaattgtcaagaagttctgattgatatgcaagggtatttaatacctcagtaaaaagtgttggtatatcaagaactttatcatatacatttaacatatctttatttctataatttacatcctctttttttatgttttcagaatattcactatcatatgaatttccagaattgttttcaggagcatcaatattatcagttatattgttttggaatataatgtctgatgaacctggaagcatttcatctttttcatttaaatcaagattatcttcttcagtagagaaattatcatcaatttctctttcagtatgtttatatataggatcatcttcaaataattcaagttttaagtaaggaggattgctacagttacatgatcctaattttattatcatgcttgaatttactgaagtaggagtaaaaataaagttgtagtttatatcaaattttgaaagttctttgagtatggatgttacatttatttttatatatgagccggttgaatttctaggcatactcaaattcaatatttccgtagaaccttcgttaggaaaagaagtccaattaagaactggaatatcaatatgttcataattaccgcatattccaatattacttggagtgttgccagaatatttcatgttttctacaaagatgaatatataagcacttttaactgagtctggagttatatcagaaagtttgaaatttaatattgttttatataaatttactccaaggttacggttattaatgatcccagctattaaattactactttttgaaaaattaacgtaagaatgatatttatcaacatatgctgcttcactgcagtttattttaattgtatttaccaatttaattatctcctttatgatttctagaaaacactttagtgcatattatatataatgcaatattttaaattaatagttaatctaacccaagaattttttcagaagcatcaaccatatacaaagtaaaataattaaaagtaccatgtttgttattgttatcatgataattacaacatgtaaatggtagggcagaagaagctccagaaatagatactttatcccatgtatatccaccatcaggtgagatacttacatataaattatgatattcaacccaatgggcatatatagtatcattatattcaattacattaggaaatgtacatgcaactgtgtcacttaatttaaaattatttaattgtttaaaatcaccatcatcaaaataaccatgtatgtaagtacaataatatttattaaaattattttcagaatatattatatgataatggtttttagaatccttaatagctgaaagatagattttgggcttcttagaattagttaacttttgtggagttgaccatttacataaagatgtatcaaaaattgagacaaataattcttcaaatccgtttacaagcttgtaataaaatatataaggtgaaaagtcgttatcatatgtaactaaaaagtttgtaaggacattatatgaaaatgaatcaacgacatatttattccaagttaaattatttttataaagatgtattaattttacattgtaagggttcaacttatctatttcataatagaatatatgcgtaaataaattaaactgttttgcataaacaaattttacaaataccttatcaggattatatttcagtaaaacattttttattatatatttatctgttatacgataaaaaagcaatgagttttttttatcattaatgattccatatattttatcatcaggagttaagtcaaaccagtagtcaatgaatgagaaactgccgccttctatttttctagatgataataatttaaagttcatatcaaaatttgaaagattaataccatcttcagaatctatcatgaaaatcttgtcattggatttatgaagtatagtgttgaattttctcataaaagtcatttaaaccctcctgaaatatttcttctaatatatatattaatcttaagttaacattatacttgttctacattaaaaagcataaatcatctataacttttatgaacaaagtaattactttatcataatatacactataaagataaaaattatcgaaatagaactttcataaattaaggaggttattttataatggcaaattgtaatggtacaacaccatcaccagtaaataataattgtttttccagtagtactggtactgtttcaaaaataaactgtggatgtactccttgtgatgcacctgtaataataaatcagggagacgtatcaactcaagttttggtacctgtacttgctgatgtaattcaaaattgtatgtgtataaataaatatgagactggatatccagtaaactgggtattccaaactaatatactaacttctactagtccttcaggaccagtatgtatcacaggagtaaattatagttatgactgtgtaggtgtaaactctaattcaattgatgcatatattgatagtaaatctactactttaacttcttcagtagcagcttgttcatgtaatagtgaatatttatataatcaatttactggaagtataaaaactaattcttgctgctgtaaccaggtagagcaagcttatgcactaactaaaattgtagaaaaagaagtaacatttagcgtatgtaatttgaaggtatcaataacaggaacaataggttcaactgcatttactgcaaatttaattggtacagttaataataatgctataacatcatttgagagtccaatagaattagaagatataggattccctagtagcataaattttgcaggtagattatgtttacctacaaatacaaaaataactattaaagaagaatttgataattgtataatagttgattgcatacgtcctataaatacaaattatacaccatcagttactggtagcttaacttatgcaacatttactacaactgctgacttatcattagtaataaataaacaaatttatgctacaacaactgagaaattagctgtaatgactaattcaggagctcaagtagtttgtactgatggtgcaacaacaacaccagtatgcccaccattatcaccttgtgcaagtactacaccttgcccacaaccagtaaatagaacagtataaaaataatcttaatatgaataatacttttggtattataacttagattataagctttaaagtttataaagatatgctccaggatttttatcttggggtatttttatattgtaaacataagaaaatgaaaaagtgacattatcaggagagggggcatatactatattaacaagtaaaagtattaatatagtacactgtagatattttataatatattttagttaaaaatattaattgtaattctaagtaaaaatattgtgagatatcttgaaggtaaaaacatttattagtatataggtaataaataaaataacaaaggaaaaggagaaataggtaatgtctctaaatgttaaatatgcagaaaagggaagcaaaggtgctcttgctggattaattggatggatagattatggaactgttatgaatttgtctccaggacaaagcactagggtagtaaatactattacagggggatataccataagttttgatttgtcacttgttcagacatacactggacaaacgacttcggcaacaccaatatcctttaagggatttacaacgccagttcttagttctggtggagtagcttttggaaatacaggatatacaggaattgatggaaatgttgcactttatatgagtactgaaagtgatcttggagtagacactatatctaagcttaatttaaacaacattttagttttagattcttcacaaaatcctgtatcaaaattctcaataatagtagcagatgcagaatcaacaaataaagttgaaacatggtctgctacaaccaatggaacagcttgggctttaattgatgtacttccagcaccaaacggaagtactataggtggaccaataatttcaggagtaggtacaaatacagtaaacgagactggtgttaatgtaaatatgggtaatgtttctggacctgtttattttacacaaagacctacacaagtagttttagggtgtctcgctgaagatagcagacagggctttgttgttggagttataataaatcaggattgtaactgtaatttagatattaataaaaatgataaaatagtaaatatatgtcctggaagaacacaatattttaaatttgtagtatctcctagttgtggagaatatactatagtttatactggaagtaactataatccagaaacaggaattataactggaagtttagccacttaccagctcactgaacaaggtattatagtttatgtaaaggctaatctgacatctggtgcagtagaagtgcttccttttgaaataataagtcagtgtggagtaacaaagtttgagattgtatttgcatataatccaagtgaatgtagtagtaatacaaatttaacaaattgtagtgggtgcaattaattttatatttgaactatccagtgaaatgattggatagttcatttcttttgctttaaatttatagtactaaaatacttagtactataaattgctattagaattattttgttgttatatgaaatatctattggaaatatacatataaggaccgtaataaaatttataaagaaaagggagtatgaattttgaatgacatagaagaaaatattgctgtatataatcattcgcttaactttatagttaaattcaatgcaccatgtataaaagaaatttatagctcatttattattgaagaaactctccatagagcacttacatttaattacaagaacagttctgtaaaatgtgaaggagaaattattgaggggaattttcaatatgatgatggtgagaaagcattaaagatagaaattgataatccagcagtggaagaaaacaaagaaattgaaataacactcgcaacaaatataactgatcttgcagcaatagttgaaagtaactatataattagcaatatggcttatattaaaataaagggatacgaaggtgtagatggtttaataacaaaatcaaatctaataaatataaagtttaatagtgttaaaataaatatgaaagcagaaaaaattactaatatagttcctgcaatagatggggaaaaaataagcgctaaagcttcattcaatactttagatacaaatgtaaattatgatattcttttaaaaaataacataggtgaaaatcttatatttgatcatatgcaaagttatgcatcaatagatggtaaaaagatagaaaacttagagtttgttcaggatggaacatgggtaagtgtaaattttcataattcaaatgaaataaaaaataagaagatagatgtaataataagtgctaaaatacaaaatgctcaatgtataaatgacatgatttcaaatgaatttattttatgtataaataatgttgaatgtagtagttgttcaacacaggttcccattattaaaccaatatcagcgcttacaaatatactgatttctaatacttaaaaatccttgtttagaatatgataaaattctaaacaaggattttattttgcaatgactataggtaatatagaagttataagtacttcaccatttagagtaaattcaagtttaatatctgcgttaaaactatctttagatgttaagctataatttgaatttggagtgacagaagatgccttaatactgggatttaaacattctgaaatattgaatttatttgtattctcaggaatatccacatttatagtaacatttgtatcattaattccaaaatagctcaagttatataaatttgaatagaaaatgtatgctgtaaaattatcagagcctattgcacctgaaactcttatatttaaattacacacataaaatgatagatttagtgtaacgctttttgttattatcgattcttcagaagaagaattattatcatatatttcagtatttatagttttagtagattcttgtatattttcattgttatttatctttaaatttgatgattctatattaaatgtttgtccgttttcagatataaaattaaatgatggaagaatattagaatttaatttatcattgctattttcagtatttaatacttttgatgaagtcttttttaatattatattagaattaaagttattaacaagattaatatcattatttattgctacaatagatgttaaaaaagataatgctaatttaatattacttactattgtttgataatcgtcatttatgcaagaataagaagatgctatagctgcaagagtatattttataagatttactgtatttattaacgaataaataggattaattgaattagcatcacagttaaaaacagtggatgaagaaataatttttaaacataaatccaatgaagttattatttttgaacatacattttcaaagtctaaaaaagatggaatattattttctgaaatttcaatattttcaatataatttttcaaggaagcttttatggaaattaatgattgtttatcattagtgttgaaagaagaatctatgcttaaattatctatagtattatccaaaagctttgttgataaaacaagttcattatagatctttaagctatagttatatgttatagatgattgtccaatcaaaaaataaagatacctatcacaaatgcatatagaatgaatgatagtccatgcactgtttataaaattctttaaagaatcataacagcaacagaattttatattatcattacacgaaatataatctgaaatagtaaaatctatatttactagattctgaagtcctaaaagaagataagtttcttttgatatataatccttagaatcagagctattattgagcatttgtaaagtttcttcatataatttattaatatttggaatggtatttataactgaaggaattgattcttcagaaatatcttttgatagatttaatgtggtcaatctttcagttgatgttgtatctgatagaacatttaataatcctaaatcagagtaatatgtttctatatttgttattgttatagctgaattatccatataagaagtattggaacatattgtgaaagtctgtgtatctacacttccattttctgatgaattgaaagtattgctaccaagtattttttttactagtgttggtgtatttgaagcaattttaatgtccattattgaagatatccccctcaataaaatatgttgcttataaaataatataaatagttcattcatttttattataatagtaaaagaattaatttattcatggtttattaaaattatgtataaaaataagcttggttttttaaaaatatattttaaaccaatagatattattacagtatttatgtaaatttaatctacaattattaacttaagttaataattcaaatttccgttataagataatatataattttgtctgatacagtatgaatgcatgtaccatatcagacataaaaatatatctagcacttccagttaacagaagttgtaattgccgatacaggtttatttacagaaactgaaatattagtatctaacttaaaatagcagtatagtgaagctgtgaaggtattgtatggaggagtattgtttatattatatttcgagttaggtattacacaatctacagtgaaacatggattgaaattttctcttaatgtaaaagaagaattaaaaggaatacatattggacatgcaacttgaaaaccattaaaacctaaatcttgtaaagtggtgtctccaggatatgaaactgaggctgtaaaatctttgatgcctatagttccagatacagctatttttaaatcacatatttgataagagtatataggatgatagaatagttgcttaatataaggtgaagtaatatcaaggcagcaacaatttaaatttttacatttataaggggttagggtatctttaaaataattatataaataaatttcagtcatagaacttttatagtttactgcttgttttgcataatttgaactatctataatagcctgagaagcactatctaaaatatgaattttttcaagatcatcatatgagctttcagttgaatcacttacagcctgaacagagtactggaaaagaaagaatccatagatagtattataaagtgaatctacataaggctgtaaactgctatcatcaatatattgtataagataatatattgatgaatatgcatatgaagctgaaagataaatatcatatataatgttatttacttgtgtaaaagtaggcgaaactggtaaattaataacatcattttttgcattagttgcaccggttttagcaatattagcagcagttatagcctgggaaggaacaccgggaaatcctattacagtgtcagcagttaggttaattaatcctacagcactattatttaaattgctagcatcataaataaggtctgctatttgagatataaccccagcattcattccatttaaaagggtggcgctaagttcacatgcagagcctattctttcattagcagttgcaagatataacatagcctgcttttcagttgatgctggaacgaaataatttataattgaacttacagtatctgctgcatatgataatgttttgccaagtaattctgcagctgaaattgcagatgtatattttttatttatggttgtagatgataagactgattgagcactggcaatagttgcatttgcagaactaattgttttattaatttcagtttgaattttgctaggcatagaatttgatgtgcatggacatccagcaccatctgtatcaaaagtattcatgttgtcgcataaataatatgaaagtgggagagttaagccaagacatgtgtatgaataggtaatgttattgatgcatataggggcattgtccataaaatttacatcagaattatctatggtaaaagtgataggacttgaccgaagatattgtccattactaaatgatacacagtcaatgatgtattctgataaaattggagtattggatttcgtagaatttggaggtagattatacacaaaaggaaaacatgatgtttctactaaatcaacatttatattttgtgtcttcttatctatcttatttaaggtcattttttacatctccttaattttgcttatattagttactaattatataaatatatagataatcattttctaatatatattatttattacaattatttttgttacttgggttagaagcataaattatagttaaaaaaattacaacaactgtttatcaaggattttaaatagttgttgtaattttatataaattattagtagtatttattaataatatttcattataagatttatctaaaataataaaaatatagatttgaatgaacaatataaaaattaaagtttaaaatggatgtgggtctatattaagcactgtactttcaggataagggttagttttagattttgcagtaactaaaaaatcatatcttacaccaaggctatcatttgaagggataagggctgtaattttgatgactttagaactatttggagctaaattggcaagtacagataaatcagcttgataaagagtgttttttggaacatcagttattttaacatcatctatatataagctgtaagacaaagcaaccttttgaattatcaacgtaaaatcatcatatcctccaccagtatttttaaaataatcaaggataacagcagtatttcctggtggagtaacaataaatgctgttgaatcattaattttatatagaggatttggagctaagcttacacctggaggtaatatacagcttaaaatattactcttttcaccgctgtaaaccttagttagagagagatcattataatatgaaattgcagtagcttgagtattaattgtagtaccagatcttaaagttgataaaggttttgtagtaaaggttatatatcctgatactgatggtcctaattgaggtacagtaataattatctttttagaagagctgttataagttgcgttacacaagaccgttgtatcaattgaataaaataaaaaattattatccaatggtatttctatggttccgttaacaaggttaatgacactgttattttggaaaataagcttaaactgcatcaatgaagatgtgctgatattggcactagaattataagaaattgaagttgttttatcagttgcacttaaattcatcaatagatttggatgatttattgttacaactaaagttttagtaatagtagtatatcctgagccttgagtttgttgatataaacactgcattgtatttgtctgtgttgaagtcagtgtatttactgttttagttgcattacttactttagcagtgaaaacatatgtgattatctgcgatgataatcttgcatctacagttccttcagtaggaaatgtaattacatttgaagaaacagaaggtgttattgctacaccatttctaaaagaaggaccgaagtagatttgaccaccgcttggaagagtatctttaacatatagtccatatactattgtaccttgtggaacaatgaatgaaagagtataagttattgatgacccaaccttaaaagtatctgaataattagtttttgataatgttacagctaatgatgatagggtaacagatgctgttttattcaaaccagtatattgaaagtttgtactgcttgaattataaacctgggaatatggattagtatttgtagcagttgtagtaatggttattccaggagaaagaacagaacttattgttacattataagttaaagtaattgactgtccaggcgctagtttattaatatataaaattatattattgctttgaactacaggtgaattaaaattaccagaacccgaagcttttatactgtttacatcaactgtaaaccaagatgctgacaaggtatcattaagtgtgaaatcaaaagcatcagtttcagttcctaaattgtttgaattacttattgtaactgtataggaatatagttcatttgcttgtatagcacttttattaggtcctgcaacagtttttgttaatgttagatttggtgtaccgatattaaaattaacttgggcacggctgctgtaagcatatccataagtgtttattccttttaatttcataagatttgcattttgcgttgaggagccaagggtcgcaattggtgctttaaaattaatagtacctgttgataatccaggaatatccccataataaaaatctaccccatgagggcttataagggttggagaagtaataggagaaacacctgtatatatataagtgagattatttataggatcagaagataatggaaaaaaatcatctaaatatacctgtttctgaattgcctttaaagaagcagaactataggttaataaatattctgcataatcaccaggagctaatgaatttatagatttaggagtaccatctttataatatcctttaacaaattgttttgtaattgttccaataccaatgcttgaacttacgcttgcatcgtcagttacaacatttaataatcctacaaggattgctgaaatatcacaagttgctaaaaatggatcagatgcaacgacaggtaaatttaatgattggctatcaaatttatatctataataactgtctacttttgcacttattgtcacagttttagttgaatttggattagctgaggaataattataagttatataatatccttgtaaattagaatcatcaacaacagatacaggattagatgatgatgaaatatagtagataccgtcaggaagaaaatagtgaactacaatattttgaagactgtaatactgaccgactttatatacataggtgtaggttacgttagtctgaacatcaacagtggatttgcttattgaagttgtaattattaaatccattgctgaaaaactaaaactgctatcataagaggaaataataagaggatcagcagaattcatatttaatgacatatttagtttagttccgtgacctataagatttccagtattactgttatatctgttccatacagcataactgaatattagtgtagtactactgcttacagataaattaatatttccaaaataaatctgagtgtatagttttccgttaatactaacaatatttatagatggagatgtaaattttgaagcatcggtaccagaaactgaaatattaccaatatatcgtattccatcatccaataataaggttatattaacaagagatgttgaacttgagttattggtaaacttacatgtggcagttgtaacttgagtataatcagttagagaagctgatgttcctgcaccttttaacacttttcctgaggttgtaatagttcctgaaaaacgtacagtaatataagtcatggatatttgagaggttattactgaattattaagatcataaatacctctaggcattgtatcagcctggcatgaaacacttattcctgagaaattatatccaaatggaacagcagttccatttttgaatttagtgttacatttaactgttatgctgaatgtgaaatttacttccattggggcaaggtcttttaagttgacccaagtataagtaatgctgttatcagcgtttgtaacgctggatgtctgagtaattgatgctgctgacagtgacataccatctggtaaagtaagagaaatacccaaattatacaacctctgggaagagcttatatttttaatgtttatgtcaaaagcagaagtatttcctactattatgggcacattctgagtcttgtcaatactcatactgagtatattagaaggcataattctatcactccttagaatttagttattatattatattctaaggtatcttattatgttacgttgaaaaatataaataaatcttaaagtcaaatgttatggtaaccaaaaaaagaggtatttaatataatattattgaaggttttgtctaaagaaaccttctaattagacaaataaggagaaaaaggtatgacaacaacacaacgtttttcagcagttgataaggctgttatagtgtctactgggaatacttttgtggtatgtggcagttccactgctcaaacaataaatacctctgatttgattaaaactgatggtacatttacaagagactggacacagtcgggaagtacagccagcttgaatgttttagctggaagtacaattctttatgctgaacttgtatggtattcaacagtatttagcaatgtatcaggagcattagatttaagaagtattcaggatagtgcaataacctttacaacatccaaaggaagttatcaaattacgccaacctttacagacagtaatactggaatttcagggactattgacagattcagggcagcagatgttacatcttatgtacaaaatgcaatgtctgggaattatactgtatctaaagtgccaataagtgttccaagtacaggcttaagtaattcaagaggcggatggagtttaaacgtaatatatagaaacaatgcattattacctcaaaaagtaatttacaattcaggaatagcagttgctactccaaatacaccattacaatcaacaataactggatttacaacaagttctgatccaaccttattaaaaggaagtattagcatgattgttgctaatggacagccacttaatggtgatgagtatgtatatgtaggaccatcttttgcagcgttgagcaatataggtaatacagtatattctccaaatccaaatccaggaacagcacctaataatccaggaaacagtttcttctcaggcgttataaatgttgcagatccattaaatgttaataatgggcttttaaatataaatggtactaatggtactaacaataatgatggatttgtaccgactcaggtagtgggtgcaagaaataagtgggatataaccaatgtaaatatatcaaatactcttgtacccaatcaaagttttatagccgctcagataacaacaggtgcactaggtgacggaattcagcttgtagcattaggagcacaggtgtatgctaaagcaccaaatgttatagtaacactggattcatatgatattgatggtgacggtgaatataacgttgaagttggagaaactcttgtttatggaattaatgtaaaaaatgatggagatgtgcctgcagataatgtcatagtatcagcagcaataaattcagcatcctcatttatacctggttctgtacagataaacactgtatcaaatccaacagcaaatattataaacggaattaatcttggaactattggtgcaaaagcaactgtaacagttttgtttacagttagagtaaattcagtgccatctggaggattgttatatcaaaataccaattacagttatcaattcaattctggtcttgatgtaataactaactcaggagtaactaatacaatacagttaatcgtacagcaaggtcttttgagtattaataaatatgcatcaaaaacaacaatgagcgtaaatgaaactgttacctatacaatagatattcaaaatactggaacagaacttgctagaaatttattttttcaagataaagttgatgcaagctgctcatttgtttcaggaactgtaacaatagatggagtagcttatgaaaattacgatccaacagtaggatttagtttagataatttaatagttggaaattctactgaaatagtatttgatgtaaaagtaaattcattaccaccatcaacaaaagtaactaattcaagtttaatttcttttggatatatatttaatcaatatgggtatttaagagaaaaaacaatagtaagtaattcaactaacattcaggttcagtttaccaatataattgggcagagatgcaataataataactatcctaatataggtgatacagtaacttatacactaagtcttactaacatgggtaatataccagcatctaatgtaccagtattagaaccgttaatacctggtgcttcatttgtggatggaagtgtgaagattaatggagtaagcaaaccagcattgaatccatttactggatttaatttgccagatccaataaatgcacagcagactacagcagtagagtataaggtattaattaacagtattaacccagcagatttaatagaaaatatagccaagataccatttaaatatgaaattacaccaggtggaacatcaataaatactgagaaagattctaataaagttgatacagtagcaaattacgtatgtatgagtgctgtaaagactgtagataaagcatatgcccttataggaaatactttgtattataaagtagtagtaagcaatagtggtaatataaatgctactaatacagtatttttagatagccttcaagctgatatttcttttatttctggaactgttacaattaatggaataccatatccatcttatgatcctaccataggatttaccattggaactgtatgcccagatgaaaatattgaggttgctttccaggcaaatgtaaatacaagaccaactccaaatataatatataatcaggctagtcttgtttacagctataagccagatcctaatggaaacactttaactaatactgtatttacaaatacagttcaaactattataaatgaagctaagtacactgtagtaaagactgttgataaagcatatggacaagttggagatcctctggtttatactacaacaatcaaaaatttaggaacagtaaatttaacaaatataaaatttgctgatttcataggagtattcttacaattctatcctggaactgtttatattaatggtattaattacccagatcttaatccaagtgcccaattcccaattgaagatatgcatccaggcgatacaacaacaataacatttggagtaacaatacttgaaaattcatcagttggatatattccaaatatttcagaagttgcactaagctataaacagaatcctgatagtcctgtaataagcaaaactgtatattctaatgaagtgagaacttatgacccatatgctaaaataactttagtgaagagtgtagataaattatatgcagctgtaggtgatatcttaacttattcttttacagcaactaatgatggaagtgcagcagctataaacacaatgtttgcggatactcttcagtctgaagcatcatttgtgacaggctcagtgttagtaaatggtgtaagtaagccggattatgatcctcatacaggttttactctaggaacattatatactggccaggttgtaacagttcagttccaggcagctataaatagccttccaaatccaaatactataaaaaatactgccacaacttcctatagttattatgtagatccaactatgcagccagtaacaaagactgcaaacagtaatactgtaactacagtaattaattcttattctgcaacacttactaaaattgtagataaagcatatgcaaccattggagaagaattaaattatacagttacagcaaccaatctaggtacagtaccattaaccaatgtaacattcaaagatattattccaaatggagcttcatttgtagcaggttctgtaatagtggatggtgtaagtcaaccaaatgctgatcctaatgcaggttttataataaacaatgtattagcaggaggaaatgttgtagtagtatttaaagctactgtaacaagtgttccaactccacctgtaattaataatactgcaagtattaactttaaatatcaattaagtccaacagcaccatatattgatggaagcttaaatagtaatactgctacaacttatgttaataagatgagtgttactaatactaagagtgtaagcaagatatatgcaacagttccagatactttgacttatacatctgtaataagtaatactggaaatgtaagcataacaaatactgagtttatagataatgtaccagatcatcttacttttgtaagtggttcagtaaagattgatggagtagcatattcatcttatgatccaaatacaggatttacactaggaactattgcagcaggatctcatgtaacagttactttcaatgtaactgtagatagtgtgccacctagaggatatgtaactaattcatctataattgattatcaatataaaattaatccaaatggatcttatattacagcttctgttacaagtaatacagttacaacttatattaatttaggtagtgtaactataactaaagctgctgatagaaccattgtaagattgacaaatgttattaatcatgattttgtaataacaaatacaggaaataccattcttacaaatgtattttttaaagatattcttcaggaagaatcttcattcaatacaggaacagtatttgtaaatggtgttaatatgccttcctataatcctaatacaggatttaatcttggtgatatcccagttggacaacaggctacagtaagctttaaaataactgcaaattcattaccacctcaaaataagttattgaataatgcagatgtaacttactcttattatgtagatccagcaggaagcgtaacaacaaagaccatgacaacaaatactactacagtatttgtttacgatactattgtatctgcaaataaagctgtggataaatcaattgcgaaaattggagatactttaaactttacaataacggttaagaatgagggtaatgttctagcgcagaatatagtatttaaagatattttagacactaatatttcatttgtcactgattcagtatatgtaaatggaagtcagaaaactggatataatcccaataatggatttaatttaaatgatattgtagcaggggatactacaactgttaattttgcagcaacaataataagcaggccattaaataatattatttataactatgcgtctgttaattatgattatactgtaggaacagaggtcattactgcaaatatcaacactaatactactcagacttatgttgctgtaggggaattaacaattactaaggtagtagacaaaacttatgctacagttggagataatttagcttatacagtagtagttactaatactggttctgtaaatgcaacaagcttaagcttccaagatttaataccatctacaacttcctttatcagtggaacagtagttgtagatggagtagctcaaggaacatttaatccaaatacaggttttcttttaactgatttaacaccaaatcaggttcatactgtatcatttagtattcacgtagattcattacctcaaagcggcaaggtagataatagtgcaaatgtaacattcacttataagttgacacaaacagatagtccagtaactaaaactacaccttctaacactgttactacctatattaaattaggttatttgacagctacaaaggcagtagataaagcttatgccactatagggaatattctaaattatacagttactataaataacacaggaaatgctaactgttttaacgtatttttcaaagatattattcaagcagatgcaagctttgttgcaggatctgtaaagattgatggaacatcttattcaaattataatccaaatacaggatttaatttgaatgatatagctggatatggaagctgcctagttactttctctgtaacagtacagacactaccatcagattattatatttataactttgcaactatagattataaatattatatagatccatctaatccacctgttgtaactgagggcagaacaaatactgtatctactaagattaatttaggaagtcttactcctactaaatcagtaaataaagcttatgcaacaattgatgatttagtgacttatacagtaagtgttgcaaatacaggaaacacattagctaaaaatgttaatttcagagatgttattccagcaggtttgacatttgtacaaggttcagtaacaataaatggaacttcttatacaggatataatccttataacagtttcacattaggtaatatagtatcaggagatactgttgttgttacttttgaagctattgtaacatctgtaccaaatccgtaattagtaactaatacagctaatttaaccttctcatatcgtattgatcctaatggttcagatattccagttcagattaattcaaatacggttacaacacaaataaatctaggctcaatagcattatcaaaaactgtaaataagacttatgctacaatgggagatattttgacttatacagttgttgttactaataatggtactgtaagagctgacaatgtaatctttacagatagtcttcagagcgatataactttcaatgcaggttctgtaaaagttaatggaacaacttatttagattatgatcctactgtaggatttaatttaggaaatattaatccattagataatgtaactgtagtctttactgtaactgttattccattaccaacacatgcttcggtaataaactatgctgttggaacattcagttataagattgatccaaatggtcagtattataataaatcttatcaatctaatactgtaaatactataataattcaaccaagcatgacagtgtctaaggttgttgataaagtatatgcaacaatacagaatgttctaaactatagtcttttaattaaaaatacaggaaatacaacaatatctcagttgttctttagcgatgttttatcaaatggtgcagcatttaaagctggtactttggtcattgatggagtaagttatccaacttatgatcctatagcaggatttaatatgcccaataatctcatagcaggaaatacttcacttattcaattccaagctacagtaacatcacttccaaatccaccacaagtaacaaactatggtgcatcaaacggtatgtattatatagatccacaaggacctagctatcctataactgcaacttcaaatactgtaacaactaatattaatgtaggaagcttatcaaatactaagatagtagataaaatgtatgcaaaagttaatgacacaataaattacacttcaactataactaatactggcaatgtaaatgcaactaatttattctttacagatatattacaatccgcattaatgtttgtatctggaacagtaagtattaatggtgttatatatccagcattgaatccaacaactggatttgaattatctgatctagctccaggccagagtgtagctgtagggtttggtgcaaagataatttcacttccaactccagcatatgtagagaatacttctaatattaactttagttatagaattgatccaagtggttcagtaacaactaaggatgtaccaagtaattcagtaacaacaaatgtggttttaggtaagataactgcacttaaagctgtcgataaaaccatagccactataggtgatgaaatcacttatacaatcacattgactaatgtaggtaatgtaattgattatagtgtggtattccaggatacaccatcaaatggagtaacatttaagactggaagcgtaaaagttaatggagtaagccagccattaagtaatccaacaactggatttagtttaggagatataggaataggtaatgtagtaactgtacaattcgtagtaactgtagtttcagttccagcaacaaatacagttattaaccaagcagttattgcttttgaatatccagtagatccaaaacagccatattacactgatacaagctattcaaatacagtaacaacaaatatagcatatggaagtcttaatgtaacaaaagctgctaacaaacaatatgcaacaagaggagaacagataacttatacagttactattcagaatgtaggaaatattaatgctacaaatgttgtattccaagatcctacacctcataatacaatgtttgttataggatcaacaactataaatggaacagcttatccagactataatccatcagctggatttgatttaggaacaatgataccaggacagattataacagttgtgtataaagttcaaattgtagatatgtgctaatagtaaaaataattactaatttaatataaatattttaatgcgtaagtccaaattaggggttacgcattttttaataattgttcattctaagtattatatatatatattgtaattgacaattgaggtgaaaatccttacaggatttttaaaattatatgcagaataattattgcaacatatatattttgtattttattaaaatataagattaaaggaagtaatttatgtatgtttaaattattattctttaaatgaaattattacattttagctcaatttatcatgaaaatcatatactagttagtgaaattaataaaaaaggaataaaaattgagtgatattgcaaaaacaataaatgaaaattttatagataacacatataaaaaaagatattttaagcaaattaatgtaaatgagaaatttaatttttgtgaatatatagacaataagtatatagattttaaaagtgcagttttgcatctaccatgcgtaaatttaatagacactattgaaggtatatcttatgaaggacaaagattaagtggtaaaaaattagtattatgtggatatttagacacttcattttatatcaattatggaattaagagcttttatataaaaaaagatattcctttaagtacttttattgttgttccaggtgatacaaataaagaagattattatcatatagattattgcatagaggatgttacaataacaaatatagagtgtaattatgtttttataagcattacactttttattgaatatatttgtaataataaaaaagtactttgtaaagatggcaatttataaattagtaaaaagcaattgtagtaaggatgataattttgatagtaattaatcaaggaagagtgaattacaggtacaaggtttcagaagagggtccagttatatatgatacaatactaagtaaccgtgttgtaacacctattcttgataaaaatttgagtgtgagcaaagaagtagataaagtaattgcatctatttctgatgtacttacttatacaataaatattacaaatataagcaataaaactgttgaaaatatatgtttaaaagataaaatacctaaagaaactttgtttataaaggattctgttaagataaatggtataactcagtatggagcaactacagaaaaactgcatattggtaatttaaagtgccatgaaaaagcagatgttacttttaaagttgcaatatatgaggatgaatatattgatagtattaataataagggatttatttgctacgattatatatataatgttgaagaaaaaccaattgaaatgtgtttatcaactaacaaggttgaaacatacattatgtataatatattcaaacaaacatcagtatctagcaacattacaatatgcttaaggccatgtgaaaagataaaaatatgtgaaattaattgttatccaaagattataaatagtaagatattaaaaacaatcactggaaataagcttttaattatttgggaaattaaatactgcatacactatttgagatattttattaattatcaatatgatatctgtagtgatacttataaagaatatttctcaacactacttgatataccttatggctatgattattccagtgataaatgttttaaaataataaatgaaaagtgctcttatcactatttattaggtgagaatagacttattatttataatagtattttaataatagcaaataatttttaaaaatttaaattaaaaattatttgctatttttatagttttcttttatgtaacaaagtaagttatttacaaatattataaactagggaacaagtttaggagcatcaatatgtcaaaaaagaagtgtaccaataaaaaaagaaaaaaaaacacatgtgaagaagatttatatagtaaatatgacaatagtggatcacaagagaatttaaataatgaagaagatgagtatgaaaataaagaaaaatcacagaataatgatcaatataataatattgattttgaaaacatgaatgaagatgataagtatttattacaattattgtaccttcaacaatttgctaattttataactttaacttcagacagcatatttattaattcaacatctcaaggtatacaacttttattagaaaaaatttcagccagtaatgataaggaaaataataatgaaaataatagtggaataaataatacaacaaatctccagaataacccagatgcattagctcttcaggctgtctatggattttttacaagtaggttaatttccacttatattgcatttgaaacttataatatacgtgtaaaacaaaaagcagaaggcacatataaatattcattgcaaccgagtagagacattaatatttctagtatacttgcaatttttgctttatgctatgcattaaaggcttcagttgcaattgttcagagaaataatattcaacctatattgggtatataaataacaattaacaatttaaagtggatgtttcttgttgtaaattaattataataatataaatgagaactttactaataactatgggattttaatttgacaattactaatattaacttatactatagaagacaacaatatgataaatgagaatatgataaacgaggaaggtttgatataatggatttcaaaaaacttggaatatgtaaagaattagttgatatattaaagaaaaatggaattagtgcaccaactccaattcaagaggaaagcattgaaataataaaaaatggtaaagatataattgcagaagcagggacaggaactggaaaaacacttgcatttttactgcctatatttgaacagataaatccaaaatccaaggatgttcaagcacttatacttacaccaacaagagagcttgcacttcagataacaaatgaagcggataaattaaatgaagacaaaaaaataaatgtacttgcatgctatgggggaaaagatataaattcacaacttaaaaagcttaataaaaatgtgcagttaatagttgcaacgccaggaagattactagatcatatagaaaggaagacaatagatttaaagactgtaaagacttttgttttagatgaagcagatcaaatgcttttcatgggatttaaaaatgaagttgaaaagataatggaacagatgtcaaagaaaaagcagatgctttgtttttcagcaaccatggattcagcagtaaaaaaacttgcatataggtacatgaatgatcctgcaattatttctgtaaaaaaagaagaagttgacatgcattcaataaagcagtttgtagttgaaacaactgacagacagaaaagagatgctttatgcaaggttcttgatgaagataatccgtttatggctattatattctgtagaacaaaaagaagagctgatgatcttgaaacagtaatggcatcaagaaagtataactgcgcaaaaatacatagtgatatagctcaaaataagagagaaagaatcatgaagtcatttagggaagcaaaattacaatatcttattgctactgatgttgctgcaagaggacttgatattacaggggtaactcatatttataattatgacattcctgaaacacctgaaagttatgtacatagaataggaagaactggaagagctggtgaaagcggaattacatgtatgtttgtagatcctaaaaataaaagggctttggaagaaatagaagatactataggatttaaaattccaagaagatctgttgaactttaatctaaataagaatagttatcaattttgttattgtagaatggtgattatatagtataataataaaaagaagagattaaatagaaaagagtttataagggtgattaaatgaaaatttcaacaaagggaagatatggattaagggcacttattgatatatgcgtgtattcacgtaatgaaatggctacagtaaaaagtatttcagaaagacagaatatttcagaaagatatttagaacagattttttcatcgcttagaaaaggtggtattattaaagccaagaaaggtgctcagggaggttattttttaactgatgaaccaaagaatttcaccattgcacaaatattaagtgtacttgaaggagatcttttgctaattgatgtagaagcagaggataatgacatggaaaattatcttattgataagttatggagtaaagccaatgaacaaatcagaaactttttctgttcaatgacattagaagatctttcagatggttataagaataaaggaaaagacgatatgtattatatttaatactatatatattcattgacatagtagtaattgcaaatttcatagtgcaacatatatattgtaataaatatagaagatacaaattaaataaattcatgacagtatttttacattcactgtaaatattattgaacttaaaataaaatctcaaattttaacaaaaaagtattgaaatattttagcttgtatgatatattacaaatatagtaaatatgctttaaaaagccgttgataagaaaagtaagcaataaagcttagtgtaaagagaatctgttatttttggtgagaaacagatactgtagatattgctgaatgggtctttgaggtgatattctgaaattattttaaagtaggaatatacggaagtctaccgttatattgacaggatataaattatttattattgtggattcagtattaaatttgagtatctgtattgaagtatgtacataggtggcatagcgaaattatagcatttcgtcctgtattaaggatgaagtgcttttgttttttcaaagtactataaataatataattttttaacatacgtacgttgttttattttagtatttgagaataatatatttaaatttcctaagctatttttacataaaatttgggtggcaccacgagtcacttcgtcccaatatgagatgaagtgactttttttgtgtataaaaatatggattttactatatatcttatgaattttaaagagtagaagaattaaaggaggtagttagatgataaatatttctaaagatcaatttaatgaaaaaagaaaagaaaataaggttttttcattaataacagaatatagaggtgatgaagttacacccataagaatttttaatggatttaagggaagaagaaaattcatttttgaaagtggaagcacagaaaattattttggacgatactcatacttaggtgaaaatccgtataaggaaattttgggagaaagtatagatataattgatgaactaaaaaaatcaataagattagattttgacgaaagtacaaatgatttttcttttaaaggcggagctataggatatatgggatatgaaacaatttgtttgtatgaaaaaagacttaaatttaataatccagatatacttgacttacctttaataagatttaatttatacagcagatatatatgctatgaccactttactcacaaggtatttgtcattgataacatattaaatgatgaccatagggaatatgaaagcatagttgaaaatcaaagagaatatatattttcacttttaagcagacctactaatatagaagaatttgaagaaaagaaagatgtccattttgaattgtgcacctcaaaagaaaaatatgaagaaaatgtacgtataggaaaagaacatattcttgcaggtgatatttttcagtttgttccatctctaaggatgaaatgtataacacaaaaatccttcgttgaaatttatagaagacttagagaagttaatccatccccatacatgtatttaattgattatgatgattatcaagttataggagcatcaccagaaagtgttgtaagtgttaaaaatgggagagcatctacaaagcctattgcaggtacaagaaaaagaggcgaaactcaggaggaagattcagctcttgaaaaagaacttcttcaggataaaaaagaacttgcagaacatgttatgcttgttgatcttgcaagaaatgatatagggcgaataagtgaaattggaactgttgaagtaaaagactttatgaaaattgaaaagttttctcacgtaatgcatattacaagtacagttacaggaaagacattacaaaatatagacggttttgaagcattaagtacatgccttccagcaggaactttatcaggagctcctaaaataagagcaatggaaataattgaagaattagaagaatatagacgtgatatttatggagggtcagttgggtatttctcctatggaggagatacagatatggcaatagcaataagaacaatagtaatgaaaggcaatactgcatatcttcaagcaggtgcaggtgttgtttttgattctgtcccagaaaaggaatttgaagaggttcagaataaattaatggcattaaaggaggctttaagatgatacttttaattgataactatgattcattcacctataacctttatcagtatattggggaatttgcagaagttaaggttgtgagaaatgatgaaataaccattgatgaaataatagaattaaatccaaaaggaatagtgatttcaccaggtccaggtactccagatgatgctggaatttcaatagatgtagtgcagaagcttggagctagatatcctatacttggaatatgccttggacatcagagtattgcacaagcttatggtggaaagataatacgtgcagacgaaatataccatggaaagacttccaaaatatctgtaaagggcaaattaatatttgaaggaattccaaggaagatggatgttatgagatatcattctttaatagtagataatatgtcacttccagaatgtcttgatgttataggatctacaatagatgacaatattataatggcagtgaaacataaagaacatgatgtttatggacttcagtttcatccagaatcaatttatacacctaaaggaaagcatatcataagcaattttgttattaatatctgtaacgaagaacagaagtaacaaagaaattaaagtttaagtttaaaaagatataaattttcaggggcaataaaactaattgttacatgttaattgccaatgagcatctaaagttgtagcttaaaagcttattaactgttacttgttaactgttaactaaataaggagggggattaaaaatgattattgaggaagcaatcaaaaaattgggagcaagagaagtgttaagtgaaaatgatgtgagagatgttataaatcaaataatgaaaggtgaagcaacttcatgtcagattggaggcttcttaatggggcttaggataaatggagaaaccccagagcagattcttggtgcagtaaaagcattaagagataactttattcctgtagaaattaaaaatccaaagcatcttattgatacatgtggaactggtggagatggaggaaagacatttaatatttcaacagcagtagcaatagttgcagcaagtggtggggcaaaggttgcaaaacatggtaacagagcagtttcaagcaagagtggaagtgcagatgtgcttacagaattaaatataaaaacagattatagtaaagatgaaagtgcgaaagtaattgaggaaaaaggaatggcctttttgtttgcaccacaatataatggggcaatgagaaatgttgcaaatgaaagaaaagaacttggtacaagaactttgtttaatatgataggaccactttctaatcctgcacctttaacagggcaacttatgggaatatatgatggaaatcttcttgaaagtgcaggtcttgttttaaaaaatcttggattaaatagagctcttattgtccatggagatgatgggcttgatgagataacaacaactacaacaacaagcgtttgtgaacttaaagatggagaacttaaaatatataagttaaatccagaagatttggggataaagcttgctaatgcagatgaaattaagggtggtacaccaaaggaaaatgcaaagattattatagatattttaaagggaatgcagggacctaaaagagatatagttgtgttaaacagtggtgcagcactttatgcagcagaactagttgaatcactaaatgaaggtataaataaagctaaggaacttattgatagtgggaaagcatatgaaaaatatgaagaattgactgcttgttagaaaactcattagaaatttgaatataactgactatcttcaattgaaattctgttaggtttttatgaaaaaatagattaaaactgggggcatatatgattttagatgaaattattgaaaaaaagaaaatgagagtggataaaagaaaaagtgaaataccaatagctgaattaaaaattcacgccttgaatttattaaaagctgaaaatgaaagagcaaaaggaaattacaagaatttatttaaggaagcacttttaaaagatggtctttctgtaattggtgaatttaaaaaggcctcgccttcaaagggaataatctcagaagattttgatataatggaaattttactttgttataacaacttgggagtacgtgctttctctgtacttactgaagaagattattttaaaggcagtgatgaatatttaaaaagaattaaaaaatcttcaattactccaatacttagaaaggattttatcatagatttttatcagatatatgaagctaaagtgttaggtgcagatggaatactgcttattgcatctgttttaaaggatcaacttggagacttttataatgaagcaaagaaatttaatcttcagcccttggttgaagtacataataaagatgaacttgaccttgcactcaaatatgactgtgatgttataggaattaataatagagatttaaaaacctttaatgtttcccttgatgttacaaaggaacttaaaaagtatattccacatgacaaaatactagtttctgaaagtggaataatgagtattgaagatttaaagacaataaaggactatggtgtaaatggtgtacttattggtgagtttttcatgagaaatatagataatgctgaatttaaaaatgaagtaaaaaaaataattaatatttaatggtgctatttttcttaaagaggaggtgattttattaaaattaaaatttgtggaataacatgtgaaaaggaaatagaatacttaaatattttaaaaccagattatataggttttgtctttacaaaaagcaaaagacagataagtgcatttgatgcgaaacttttaagaaagaagttaaatccagaaatcaaatgtgttggtgtattcaaagacaactctcttgctgaaataaataatattttaaaaaaagtgaacctggatgtagttcagcttcatggaagcgaaaattttgattttataaacttacttaaaaaaaataaggattataaatttgaaatctggaaagcactttcaataaataacaaaatatttttgaatgaatatgtttcatattatattagaatgaaaaataattgtgttatggataacattcttatagatggttgtaatcccgggagcggtgaaacatattcacttgcaccatttaaggaaattataaaaaaagaatgtgatttaaataatgattttaaatttattcttgcaggaggaataacaccagaaaatgttttgttaaaaatcaaagaagccaatccatggggagtagatgtttcatctggtgttgaagatattaataaaaatggagtgacaatgaagtcatttgataaaatgaaagttcttattaataaaatcagataaaagaagtttttagtatataaaaaaactttaacgttaaaaagatgagaatgacgtaaaagctactaaaaagaatgacattattataaaagaactagaaaagttaaggtatttattaagaaatagtagccaagttatataaagaaattacaaagagttttataaatatagatattaaacaattaaaaaataaagaatggagaatggataaatatgagttgtagatttaatgattatggtggacagtacgttccagaaaatatattaaaggcattaaatgaattggaagcagaatatgaaaaagctaaaaatgataaaactttctgggatgaatataagtattatttacgttattatacaggaagaccaagcccgctatactatgcagaaaacattacaaaggatttaggcggtgctaagatttacttaaagagggaagatttaaaccatacaggtgctcataaaataaataatgctattggtcaagttattcttgctaaaagaatgggtaagaaaaaagtgatagcggaaactggcgcagggcaacatggagttgcaactgcaactgttgcagctaaatttgggatggaatgtaaaatatttatgggcgaggaagatatgaaaagacaggcacttaatgttaaaaagatggaattactgggtgcagaagttgttcctgcaatgagtggtacaagaactcttaatgatgcagttaatgaagcacttaattactgggctgataattgtagtgaaacattttatcttttaggttcagctgttggaccacatccatatcctacaatagtaagggattttcaaagggtaattggagatgaagctaaaaaacagataatggaacttgaaggtcgtcttccggattatatattagcacctgttggaggaggaagtaatgcaataggtattttctatccttttatagatgataaagaagtacaacttgtaggagttgaagcagcaggaaaaggtgtcgatacagagcttacagcagcaacaataagtaaaggtgaaagggggattatacatggaatgaacacatatgtgcttcatgataagaatggaaatattgctgaggcttattcaatatcagcaggtcttgattatccaggtgtaggtcctgaacatgcctttcttgctgatacaaaaagggctgagtataaggctataactgatgatgaagctgtagatgctttcttgtatttaacaaaactagaaggtatagtacctgcaatagagtcatctcatgcacttgctcaggctaaaaagcttgcaccaaaacttgatgctgacaagattataattgttaacttatcaggaagaggagataaagatatggatgcaatgttggaatatttagaaaggaataataaagataataatgtttaataatataatcatatgagtatattataattaattcagtttattattttattgtaatttaaaaattacaataaaataatattcataaattgtaacaaaaggttaatagtgttttttaatagttaataaattaacaaaatttccgatatagagataaaaatttcatttttttgttttcatataagaaattttagagtataataggcattgaaagaaaaattggttatgtaaacttataaccattaaatttttcttatagattatagtttatataataatatataagtatacggaggtcgtacaatgttagtatcagcaaaagaaatgctaaacaaagctagagaaggaaaatatgctgttggtcaattcaacatcaacaacttagaatggactaaagcagttttattaacagctcaagaaaataattcaccagttatcttaggtgtatctgaaggtgctggaaaatacatgtgtggttataagacaatagttggaatggttaacggaatgttagaagaattaaacatcactgttccagttgctttacacttagatcacggtagctacgaaggatgctacaaagcaatggaagctggattctcttcagtaatgttcgatggatctcactatccaatagctgaaaacatagaaaaaactaaggaattagttgctaagactgctgaaaaaggattatctttagaagctgaagttggttcaatcggtggagaagaagacggtgtagttggaagaggagaagttgctgatcctcaagaatgtaaacaaatcgctgatttaggagttacaatgttagctgctggtatcggaaatatccacggtaaatacccagaaaactggcaaggacttgcttttgatgctttagaagaaatcaacaaagcttgtggagttatgccattagtattacacggtggtactggaattccagaagacatgatcaagaaagctatatcattaggagtttctaagatcaatgttaacactgaatgtcaattatacttccaagaagctacaagaaaatatattgaagctggaaaagacttagaaggtaaaggattcgatccaagaaaattattaaatccaggatttgaagctataaagactatcgtaaaagaaaaaatggaattattcggttctatagacagagcttaatatttacaatatataagactttctcatttaatgggagagtcttttttctttaaattattaacggaaaaagcgactaagccactttgtgattttctagaaatcacaaaaatatttatagtgtatattatattaagtatgaggggtgatattatagaaagcgataaaaataaagttaatgatgaaaatacagaatattataatgaaacaataaaagatatgcaggatatggaaatattagaggcccaaagtcaggcacagattatacttgccctaggataccttttagaatataaagcttccaatcaagctatggaaataattaggcagagaatggctaaaagaaactcagataaagctgctggtaattatgaaaatgaggaagaaaagcttgaacgagaggaaaagaaatggattaatgaaggtcttaatgcagacaagactgcacttattgcagcagaatttgaattgtatggccaaattatattaacaaatcttgattatataaaacttcaaagactacctaaggatataaatagaagagatttgatgcttacaacaacagctaatgatgaaattttttatggagcagtttttggattgattggatttatgctaaattataaaggtgtcaaaattttgtatgatataagcaatgaaaatgttacttttgactaattcatatattataatattggctaaaattataatatatggaattagtcaaaataagaatatctttttgaaaacgtttatgttacaatataaataacataatgataaaggagttgaaaaagatgagcggtaaattaagcggaatgttagcaaaaacattggacaagcattttagcaatataatcaaagtaataaatgaaaaagaaaattatgataatgccgcagataataattatgatagttcatctgagacaacagaaaatattgatgatatttacatagatgatgaacaaaataatgtgagcttgtatggaattggagtagaaaatgaaaaaattataattaatagtaattttgatgaagaaagtacaccatttactattatgacatgcgaaggaataaaactctatataaatgaagaattgtgtcgtgaagatactaagtataatgtaactgaagcagataaaatacgtactgtaagtgaaacaatagagggaaaacgtaatataaatataagcatatctaaggattcaatggaagcatatgttgatataagctacactccagaatatatttttaaacttaaagatatgaacttcaaaagtgacttaaaactaaaggccacaagagaaaagaatggttttttacctaagtatactgttacagaaataatgaatgaattgggtagaaatggagttaaatatggactaataaaggaaaatatattaagagcaagtttagaagaaagtgtaaaaaaattattagttgcaagaggaaataacccaatagatgataagcctctagaagtgaaaatattatttgatattggagataagacacatttcaagagtgaatcaatggaaaaaattgattacaaaaatgtatattcaataagtagtgtagaatgtaatgaagttttagctgaaattatccctgaaaggctaggacaaaatgggaaaaatataaagggtgaaataattaagaaaaaaggtgcaaagagtaaaccagtaaaagctggcgatggatgtaaaattgaaaataataaagttatcgcaactagagatggtagaccttcatctaaaaatggtattttaagtgtaaataatgtttatagcgtaaagaatgttgatatgaaatcaggaaatattaatttcttaggtgatgttcaaatagatggaagtgttggtcttggaatggctgtaaaggctggaaattcgttgataataaaaaatgatgtggataatgcctctgtagtagctggaggagaaataaatattaacggtaatgtaattaattcaaaaatatatacaggacaggttgatattgaaaaaaaggaatatttggatatactaaatgtttataaaagagaagtagagaaacttattgagggtgtaaaaaaaataaatgattcttcaaatagtaagaaaagaatttgtgatatagcaaggatattaatagagagtagacataaagatattcctaaattatcattaaatataataagtaggtgtataaagcttcatgatgaagttgataatcaattgattgattttttacgatgcaaggtcatgggattgaatatttccaatcttaaaacaatgagagatttggaatatttattagagcttattgaagaagaaattgattattataatgatgatatgattattcaaagtgatatttatgttggatatctacaagattctcttgttaaatctacaggaaatatatttgtaacaggaaaaggtgagtatattacaaatcttatagctttaaaaaatattgaatttttaaataaagatgctgttgcaagaggggagttatatctgcaaaaggtgatgtaaagcttggaacagtaggaagtattgcaggagtgtcaacaaggatagaagtacctaaagatggtattgtaacggctgaagtggcatattcaaatacaatttttatgtttggtaaacgttctaaggttttagaagaagatagcagaaattttaaagcttatatggataaagatggagaaataatttttgaaaaattcaaattataatatttacaaaaaatcgaactatattattggttcgattttttgtaaatattttgagtttttatacgatattagaattatacagaataaaaatataaaggagtgaaatttatgaatagagttgtaaaagctattattgcaggtggtgctataagtttattttccatagcaccagtatttgcacagagttataataattattcaccagcatcagcatatacattcccaactgcaccatcaactagttatcatgatgcagtaaattcaagtataccaaataataaggcaccatatggagctccacagttaacaaacatcccagatagtattggaaatttatattattcaccagaaacaacaaattatacacaagtgagttatgatgcatatattggtactatcccaatgtcatcttctcagaataaggatcttttaagtagtattaagaactttaaactttctaatttggggataaatagaactatatctgaagttctaggagcattaacacctaactatgatggggcaaattcatcttgtgcttggtatagtgatcctaataatgcaaacggagtaatatgtacatgtggaaattataaaatatattttgattgttatgcatcatcaaatgggatggacatatatgcaacaataagtagcaatgcaggaatatacacttttactcaaagtgaaataatcaatttctttaaaaaccttgatgtaaaattaactaatattgaaaatgaaaagaaagaaaatgaaactaataatccatcatatggaacatattataataattcagtaattattaatggtacaaattcaggtacaataataattaatggttaatttaaatttactttatataaatatttgattaataatatttattgttttttagaaagcactgtatatgttttgatatgctccctttatggtagacacataaaataataaaaatgtctatcataaagaggagtattttttattaaaaaattaattttattaaagctaacttttagcatatgggatataacatagtcgctttggcgatttttttatgtgaaattatttattaatacaacttcaattttggattatcttataagtatgataaaataatgaatagataaagacacaaaggagtaagaaattaatgaatattattacattagaaaatataagtaaaacctatagtgaaaaagttcttttaaaagatgtatcactaggaattagtgatagcgataaaataggtttgataggtataaatggtgcaggaaaatcaacacttctaaaaataataggaggaaaagaagaattctttgatggaaccataacaaaaggtaaaaatataagaattgaatttttagatcaagatccagattttcatgatgatgtaacagtaatagaacagatatttaaaggaaatactaaggaaatgcaaactcttagagagtatgaagatatattaaataaaatagataaagctaaaagcgatgaatttgataaattaaacagcagacttattaagattcaggaagaaattgatgcattaaacttgtgggatcttgaaagtgaagctaaaacaatacttacaaagcttggaataaaaaactttaatgaaaaagttggaaatttatctggaggacagaaaaagagaatagcccttgcatgtgcacttattacaccatgtgatcttcttattttagatgagcctacaaaccatctggattcagattctattgaatggcttgaagaatttttaaatagtagaaaaggtgctcttttaatgataactcatgatagatattttcttgatagagctacaaatagaataattgaacttgatcgtggaactctttactcatatccaggaaattacacagcattccttgaaaagaaaatggaaaggctggaaacagaagcagttcaagaagaaaagagagatgcattaataagaaatgaattgaaatgggtaaggcgtggtgctaaagcaagaactacaaaacaaaaagcaagacttcaaagatttgatgaacttgttaatactgaaacaattaaaagacaagatgacatagaattatcttttgtaggaacaagacttggaaaaaaggttgtagaattatacaatataaacaaatcatttgaagataaaactattataaaagactttagttatattttcttaagaaatgacagaataggtattgttggtcacaacggtgcagggaaaaccactttagtaaatatattaagaagcaaacttaatgcagatagcggaactattgaaataggagatactgttaaaataggatgttttgctcaagataatactaacatggatcctaaaatgagagttatagattatgttaaagaaggtggcgaatacattcctgtagaagatggaacaaagattactgcatctacaatgtgtgaaagattcttatttgatgggaatatgcagtatacacctattgaaaaattatctggaggagaaagaagaagacttcatcttttaagagtattaatggaatctccaaactttttaattcttgatgaacctacaaatgatcttgatattgaaacattaaaaattcttgaagattttctagacaaatttataggtgtagttgttgttgtatcccatgatagatattttcttgatagaatctgtaataagatattctcttatgagggaaatggctatataaaaggttataatggtaattatagtgattttcttattgcaaaggaaattgaaaatgcagaaggcagcatttcagtggcagaagagaaagaaaagcctaaagcaaaaggaacaaaagacagaagcagagaaaataagcctaaatttacatttaaagagcagaaggaatttgaaactatagatgaagacattttaaaattagaagaaaaaatttcaactcttgaaaatgaaatggctaaaaattcatcaaattatggaaagctaaatgagcttatgaaagaaaaagaagaaactcaaaatatgcttgatgaaaaatacgaaagatgggaatacttaaatgaaattgcagaagcaattgaggaatataaaactaataattaatatgaaagaggcagaaacatggaattacaaatttttttaaaaggaaaaagtgaaccttcagtttttacaggtgaaagaattgatgttcttgattttgagatgcaggggaaaaaatataaacaaataaggtattttagaaaaggtatatcaaaatctcaatatatagcagcagacttaataaagaaaatagttgaagtcaataaatagtacggagtgttgaaattgattaaacaagtattaatggacaaatttaataaaaatataacttcttcagtaatgagatctgctaatgatgttcttagaaatgaccttattaaagatgtcacaaacactttagataaagatactattactataaagtctactgttatttcagagagtcttcttagtgaatatagctgtaagattatatttgacataaaaactatggatataattggcacatactgtagctgtgctgactatgagaaaaatgaatttaaaaaagaaaattattgctgtaaacatcttgctgcaagtttttatgaattcgtaaataatgcctcttgtgatgaaaaactatctgagattttaaatggaagaataaaagaaaataaaaaaatataaactatggaaaatgaaattcttaatacacttatagatgaaagagaaaatattttaaaatttgaagttattttaagtaaaaatcactggtcatcaaaattacaggctgaatttaaactaggtcttagaaataagaaaatgtatgttattaaggacttaaatcactttcttgtttctatgtttaataatgttcctataaaatatggtaaagattttacttttaatataaaagaacaaaaattttcttatgaagatagcaggctcattaaatttatatgcaatttgaaaagatttagtgaaaacaatacaagtgtaagaagacaagataaaattatcgatggaaaactaatgacaataccatcgataatgttgaaagaatttttatctatagtcaagaaaaatagaatatttttaggtgatggatttttttacagaatacttgaatgtgatgtaatagaaggtgatattcctgtatcattttctttgaaatcagcatcacatgaaataagtttagaagttttagatattatgccagagccattaagcgataataacgatgtatttatgtttggaacatctttatatattccatctatagaacaatgtgagagacttgaaccttatttgaaaatattcaataaaacaaggaaagtagtttttgataagaatgatgaggagacaatcttaagaaaacttatacctaatatacaaaagacttcttctcagctgatcttatcacaaagtataaggaagaaaataatttcaggtccagttaatttcaggttttactttgacaaagagagagaaaatgtatctcttcagtataaagtatcttatgaaggacatgagtttaactttttcgaagaatataaagataagattatatatagagatacccaaaaagaaaatgaagtttataatattctaaaaaatcttggttttgatgaagtaaatgagaaattctatcttctaaaagatgatgatgaaatattcaaattttttaaatatgaaatagaaaagcttcaaagatacggtgaagtattttattcagaaagattcaaaggaataagatctattaaaaaatccgacttcaaaggagaagtgcgtaaaggaaaatttgactactttgaattaaaatttaaacttaccaatatacacgaagatgaagttacaaaaatattacgaagctttagagataatgtaaagtattataaacttgaaaatggtgaatatctggatttagaggaagaggctcttaaggaagctttaaatcttatagacagtcttgttataaatgaagaatttgatgataatacagttttaattcctttaagtaaaggagcatacgttgaagattatcttgataataagaacttcagatacataaaaacatgtgatgagatgaaagatcttaagattaagctgaataatattgaaaataagacattccagatgccttatggtattttagctaaattaagagattatcaaaagcagggctataattggcttagaactcttgattatcttggatttggaggtattcttgcagatgaaatggggcttggaaaaactcttcagacaattacgtttatattgtcaaaagccaattcaaaaacattaatagttgcacccacttcattgatttataattggctaagtgaatttaaaaaatttgcaccttcattaaaggttctaatatgcaatggtactccagatgagagaaaaaaatatattgaaaattataaagactatgatgttataataactacatataatatgcttagaaatgaccttgaacattatgatatgttttttgattactgcatactagatgaagcacagaatataaaaaattataattcattaaatgcaaaatgtgttaagaaaataaagagcagagtgagatttgcccttacaggaactccagtagaaaattcacttatggagctttggtcaatctttgattttataatgccaggttatttatatgatgaaaaaagatttaccacaagatacttcagaagactggaagaaagtccagaaatacttgaagagattcataagatggtaaaaccatttatattacgaagacttaagaaaaatgttataaaggaattaccagataaaattgaaaaaataatgaatattccactttcagatgaacaaaaaattgtatatgaaacttatgcagaatatgcaaagaatctgatacaaaagaaagttgaaagtgatgaatttaaaaagagtaaaatagagatactatcatatgttacaaagctacgtcagatatgtcttgacccatctgtaataatggataattataatggtacaagtgggaaaattgatgcacttattgaacttttggaacaaagtatagaaggagatcataaagttcttgtattttcacaatttacttcagttctgaaaaatataagtaccatattaaaagaaaataatatgagttactgttatttagatggttccatgacaagcagcgaaagaatgaaaatggtaaatgaatttaatgatggaaataaaaatatatttcttatttcattgaaggctggaggaactggattgaatcttacaagcgcagatattgtaattcattttgatccatggtggaatccagcagtagaagatcaagcaactgacagagcacatagattggggcagaaaaatgtagttgaagttattaagcttatagcaagtggaacaatagaggaaaaaatcattgatcttcagaactctaaaagagaacttatagataaagtacttagtgatgacttaagtgctgatgtatttgtaaataaactcaatgatgacgagattcttcaactgtttaactgagttatatctaaataagtataccttgtagcttaaaaagaattaataaatttatttctatatgacagattacttattaaaaattataaataaaaaagaaatatgaaaacataaaggcaatggtgtcattaatggtaacacattgcctttatgtgttatataataaaaacattaaaaaaagacttaggagggctatattatgattaacacgtataatgatcttatgaattacttaagagaattaaatactgtctcaattattgtgagattgactcttgcaacaatatgtgcaggaatattaggacatgagagaggaaaaaagaaaagacctgcaggttttagaacacatattgtggtgtgcattggggcaacaatggttatggtaacaagtcagtatatgacggatgttttaggaataactacagatgcaagcagaatgggagctcaggtgataagcggaattggttttttaggtgcaggtactattatggtagttggacgtaatcaggtaaaaggacttactacagcagctggactttgggcatgtgcatgtatgggactagctattggaatagggttctatgaaggggcaattattacatgtatttatttacttgctgttgtgacttttttgcatagattagatttatattcaaggactcattcaaaagtacttgaagtatacgtagaacttcaagatatatgtggagttacaaactttataaatatggtaaaatctgatgggacaaagatatcaaacatagaagtaaagaaaaatgatactatggaaagaggtatggttggacttacaatgactcttactcttgcaagaaaatgtgatcatggagaatatcttcttcaacttaacaatatagagggagtatatattgctgaagaagctttataaaataagctgaaaagccatataataaaatttgatgtaatatgataaagcatattaatataaaaattaaaagcatcaataaatgattatttaattcatttattgatgcttttattgttattgattattttctacaacactttgagcaatattgttagaatgatcaccaattcgttctaaatcacttatgatatctagaaataatgccccttcaaatgcactacatttaccgtcataaagtcgttttatatgtttttctctatagtcctttttatatgtatcaatctgattttcaactttaaagtttgttttagcttcattgacgtttctatcggtataagcaccaatagaaatatctagggattttacaacagattcataaatttcgtttaaatcatttaatgcatctaaactgtatttaacttttctattgattttttcacgtgctaaatcagcaatgttttcagcatgatcaccaattctctcaatatctatgacaacatgtagagtagatgccacaattgtttgttctttttcagataaattgcattgtgcaagttttacaagatagcttgttatggcttcttcgagtaaatttatagtttcttcatttttgtatacttgctctattagtttttcattactatcaataaatgctttcatggatagttcaacattttcttttgctttatgagccattctaatagtttcttttattacctgcccagcagcaattacaggagtttcgagaactctatcatcaataaatttaacaccaggtttttcttcattttcatcatcaggtattactttattgacaaacattacgatatatttgctaaatggcaaaagtagcgctgtgtttgtaatattaaaaatagtgtgggcatttgcaatctgtcgacttacatcagtgcttgttgtaactacaaagtcacctaagattcttaaaaatggtataaagattatagttccaagaacattaaaggtgagatgaagaaaagcagctttatgggcagttttatttgtaccaatacttgctaaaagcgcagttacacatgttccaatattacaaccaaagagtataggaatagcaagtgatacagtaattgaatttgtacttgcaagagctattaatattccagttgttgctgatgaactttgaaggactgctgttaaagcaagacctgttagtataccaataatccagttgtcaccaacagcaagcagaagttgagtaaacattggagtctttgcaagtggcttcattgcactgctcataatacccataccagtgaataatataccaaaacctaatataatatttccaagttcaagatgttttctattctttgcaaacattaccatagcggcaccaacaaatacgaataaaggtgcaatttcatcaagtttaaatgcaacaagttgcgctgtaatagttgttccaatatttgcacccataattactccaagtgcctgagataaattcataagaccagcatttacaaaacccacaaccattacagttgtagcactgctgctttgaattatagcagtaactattgtaccaacaagcactgcaataactctattacttgttactttttcaagaatgctttttaaactatcaccagcagcattttcaagaccatcacccatgagtttcataccatatatgaataatcctaaaccgcctaaaagtttaactattgtgcttactaaatccaaattatattcacctctgtcaataaaatattgtatatatattctaataaatattttacatataagtcttaaaaatcacgtaaagattttcaccttaaatgtggattgctcacacaaggagcacccaaaagggcatacaatgtcaattgttaattggaatatatattattaaataattctgtaattattattaacatgaagcaaattaattatactttttaatagtaatgatggtattcttaaaagtttattttaaatagataaaaaaatcgtcaaggcgactaagttatatcccatatattaaaaaaactgcctgaaaaacagacagtttataataacagcatgttatgcttgttcagctatttgataaagaagtttttctgtttcttcccatccaagacatggatcagtaattgatttgccataaatatgttcatcaattttttgacatccttcttcaatatagctttcgatcataacacctttaactaatttctttagtttactattgcagtctctactatgtaaaatttctttaacaatacgtggctgctcaaaatattttttgtttgaattattgtgatttgcatcaactataacagctggattaggaaaatcatgttcactgtaaagttcagcaactcttaataaatcttcatagtgataattagggatgctatttccatgtttgtttacagaacctctcatgattgcatgtgcataaaggttaccacttgtagtaacttcatgatccttataaataaagtcatgtttacaatgggctgcgtgtattgaattgaacattacacttaaatcaccacttgttggatttttcataccaacaggaacatcgacaccacttgctgtaagtctatgttgttgattttcaacacttcttgcaccaacagcaacataagttaataaatcatcacagtaaatgtgattacaaggatataacatttcatcagcaggagttaggtgtgtttccttaattgctcttataaacatttttctaattgaaaatagaccttcaagcatatttggtgatttttcaggatctggctgatgaagcattcctttatatccttcacctgtagttcttggtttattagtataaattcttggaactatgaataatttatctttaactttttcatttacttgtgctaatctatttacataatcacacacagaatcttcatcatcagctgagcaaggcccaataatgacaacaaacttatcactcttgccagcaaaaatattttttatttcttcgtctctttcagctttgattttttttaaatgctcttccagaggagtcatagctattatttcctctggagacggtatttttcttatatttgtaaaactcattacaaacgcccccttataattgtgtacattatctactatataattactggcatatttagtcaagttatattgaaaatgtgatatttcccatttatatataactaaattgatttaattatgataaaatatatatgataattgtaaattggtggtagaaaccatatattagtttctaaattacaattatagagttaatagtttaacatataggtaatataattatgaaagagaactttacttgtatgaatataaaattttattgcaataagaaaagaggggcttaataatgaaaattctagcatatagtcatagaaaagatgaaacagaattttttaaggaattcagcaaaaagtataatgtggatattgtacttacagatgaagaacctaatatggaaacagtaaatttaagtaaaggaatagagtacataagtataataacaactcctatacatgaagaattattaaaaaaatttaaagaatatggtgtgaaatttatttctacaagaacaattggatatgatcatattgatttagagaatgcacaaaagttaggaattaatataggaaatgcaacttattcacctagcagcgttgcagactatgctattatgatgatactaatgtcagttagaaaaatgaaattgatattagatagaagtacagttcaagatttttctttaaatatggttcaggggaaagaacttaaaaatctcactgtaggtgttttggggacaggaagaataggagagacagtaataaaacatttaagtggctttggatgtaatattattgctcatgatgtttatgaaaaagatactgtaaaaaaatatgcagagtacaaaaatttagattatgttttaaaaaatagtgatattttaacatttcatatgccagcaactgaagataattatcacattataaataaaaaaactatttcagaaatgagagacaatgtatttataataaatacgagcagagggtcgctaattaatactgaagatttaattgaaggtctagaaaaaggaaaaattgcaggtgcagcactagatgttattgaaaatgaaagcgggctgtattacaatgacttaaaagggaaaatactacaaaacagacactttgctattttgaaatcttttccaaatgtaattgttactccacacacagcattctatacagatcaagctgtaagtgatatggttgaaaattcaataaaaagcatcttgctctttgatcaaaataaagacaatccatggcaggtattatagagtattaacgaaatcaattgtaaaatattgacatataatatgttaagtgttatattaataactgtacattgcaaaaaaagagattatgtatttttatattgtagaagaaagtagattatacgattaaaattttagtaaaataagtacttcttataacttagcttattattgcctaatattttaagatataatttctgctcagtactatacgattgattgtataaatattattttctaaaaccaaataataatacatgtttctttgagatatttatttctaaaaaatgtgctgtggctaaattcacagcacattttttagcttcaaatttatttgttaattattcaagaatgttataaaatactgttgaggtgaatgtaatgaatttatcaaatttaatactgttattattgcaaggtggtgccggagctgtttctggatatgttacaaacaaatatgcagtaaacatgctttttaaggaatatactccatttaaaatttttgataaagttttattgccagcaaaatttggcggagtaataaagaatagaaaagaacaatttattgaagaaataagcgagcttgttgaaagagatattattaatagtgatacaattttagctaattttaataatgaaaactttgaaaaagtacttaatgagattgtaaaagaattttttaatgaagaacttaaaaagttaataaataatatggaatttagagatatacataattacgaaagtataattgacaatatattatgttgttttacagaaacattaaaagtcaattctaatttagttgataaagtgataaatgaaatagattttaatgatgacataacttttaaagttacaacaaatatttgtgaaaaatttattcaagaaattgaagaagaagttgcaaaaactaactttactagtgattgtgtaaaagaattgtatggtaaaatttccgaagaaaatattagtgaaattttatattctgagaatttagatttagtagaaaagaatataacagtaaacattgaaaaatcaattaataatttattttcaaatgatgaaataatcttaaatatactaaataacttacatgataaaatagatacaaaatctataatgatagaacttcagaagaatctgtacaataagactttatcagattatattacagaagaagaacttgataatatatgtgataaattatttgatgtatttatgacatatttaaattctgataatggaaagtcaaactttaaagaggtttcaacatttgcattaaacataattaaagatatggattatacaatctatgatattcttccagaggattcaagtaagaaacttacagagttcataaacaattcaatacataaaatgatgccatatttttctgagtggataaataaaaataaagatgagtttgatgtaataattgagaattctattgatgaagctataggaagtcttgatccaggaattaagaagatgattatatcaaaagttcgtgcattattcctagataatgtttctgctaaaaatcaaatagtagaaaaaattactaattatatagagaactataatattgatgaaaattctattgatgaaatatgtgattcaatacttaattatcttagaaacactaagataagtgaaattgtagaaagcttacagaagactaatctaattgaaaattctcaaatagaaaatttatttggatttttaaaggagcaatgcaatattcatggtaggagtataatatataatttattaaatatgcagatgtcaaaaacatttaaagttctactaaaaagggatttagatgaaatttttgaatgtaatattaaacaatggataaacgatcttataataacaaataaacaaaacattaataatattcttttggaaaatctaaaaactttaatatctagtaattttcaagattttaaaaagtctacactttcttctattattgataaagaaacattgactgataatattgaaaaaattaatgaatttataaatgggattttaaagaaaaataagaacatcttatgccataatatgagtagttatttaataaatggtttgactttactaaaaaatagtgaaaaagctaaagatgaaatatataaaagcacaataagcattgttaaagtaaatcttttagataaaggaaattctaatgtttatgatgttatatatgataatttatgcaaagatgaagtatatgaatctgtaactaaagttgttaaagatatccttgtaaaaaatttagattcaatgttaaaaggaaaagtaaaaggtactattagaaataatcttatgcagtatgatgaagatgaaatttgcgatttggctcaaagattcatggggaatgagcttaagcctttatccatgtttggaggtgtcttaggttttatctgcggtatattatttggtttggtttttaagaatataagtattaatggattttattccaatatgagtgaacagatattatctattttacttatgggctttgttggaataataacaaatgttatagctattaacatgctatttaaaccatatactaaaaataaatttttatctaaaataccttttataagaagatttgcattaggatatattccggcacataaagataatatgagtaatgcaattggaaatgttatagataatgatcttttaaatagaaattaccttttctccattttaaagcaacataaagaaaatattaaaataaaactttttgaaactgcagaaaaaaatgattttaaaatagtatcagattttataatttctcaaaaaaatataacggaaaagagtttgaataaaatatttttcaattatttcatcaataataaaaataaagcaattgaaaagataaattcacatttaatgaatacaagaataaatgaggatttaattaaaaaagaattgattggtgacattattgaaaaaacaaaaatagaagaaaaaataaagcaagtttcttttgaatatttggaaaacatacttgaaagttctcataagattgaaaagtttattttgccaggagtgaaggataaactagaagaatacttaaattgtggaataaataaatcaataaataatattagtaataagattgaaagtattcaaatggaaagcattatatgtgaatatgtaattaatataataaaaaacaaagaaatttcaaataaaattattgataatatttcttattttattagtaaaaatagcaaaagatatattataaactcaatagaaaactctggatcaaaacttacatcagtaattttgaaggatgaaaatacaatagaaacaatattaaatggaaagataaaagtttttattgataaaaatttatttaaactcacggagtttgctatttataaaataaaaatactattaatagataatgaaaagtttattaaggacaatataaaagtaaagataggagaatctctaaacttttttgaaaaaatgggttatgctatggctggtggtgatgacatagtagatagggcagtaaatattatgattcacaaaaatatgcctgttttcataagtgaccgtttcttcgaaataactaatataattaaagacagttttgataattatttatataaagtaaagataaatgaaatttgttcttcacttaatgaggataatgtaaacaaatttatatgtggaatttgtgaaaatctaaataataatgaatacataacaagatattatgaaggtagtattaatacattattacactctgtgttaaataatattgatgaagaaattattaaaacttcagtaagtaaatttgataaagaattctgtttaattcaaggattaatttcagagaatattaaaaataaacaagtatcagactatgtatatagagtatcagaagattatgttatacagccaatatataatatggaaatgaaaaatatatttaaagaatatgatttaaagaatatgaaacacttattaaacaacatatcaaataaattggaaattgaggattttctaaaagagaaaacatttgaattaatgagcgtatacataagaaataaacgcatttctaatattgttgataaatctatagcacaagagtatttaatatctaaatatactagtttatttgataagagtgaatttatagagaattctactaaaataattaatgattttagtgaaatattaattagaaatgagaaaaacatttttaattacaatactaaatcccaaataattgatattctttgtgattcatcattagattcttttattaataattcaagcaatataatagaatctataaaattaaaggcaataacaaaaaatcaaatagagctcatgaatccaaaggaacttcatgaattatttttatcattttcaggaacgttgtttaagaaactctatttatatggagcatttggagcagtgtttggtattaatttgtggatacctgttattttaggaataaaagaaagtatagatacttcaaattccaattcagatatagtagaggaacattaaaatatagagtaaaagccataaaaagacttcatgatcttatgtgaataatgaagtcttttttattaaaatgaatttattggaaaaatatatgaaataatatgcgaattaattatatttacatataagttaataatttatgaataagtttacaaagcttacattatatagtataataatttttatattatacaaataaaaggagaaaagaattgatgcgaaaaaaatacagctcattttcttgttttattttaaataaaacaagtcttaaattctttacaataactatgttatgtactttattgtgtaactttgtttttgtaaatgaaaaagttcaagctgtaacttcttctacgtcagttgcaaatactgatattgtatgttcttctacagcgtatactggtggtggagtaacagctactggtgtttcatgtgtgagaaaaccctttgggttaagtacaattgcagttgatcctgatgtaatcccatttaattcagcagtttatgtagaaggatatggttatgcaatagctgcagattgtggtggtgctattaaaggaaataaaattgatgtttactttgatagcgaatctgaatgttctaattggggtgtaagaaatgttacagtcacaatacttggaaattcaactggaaggtaagacataaaaattgatatagcatcctaaaatacgattttaggatgctaatttattttatataatattacttaagaaatcacttttaaatatgtaacaaatgttacatattaatattataaatttatatataattaatttataatattaaataagaggtaaatttatgaaaatagataatttattaagacaacatagagaaatttataaggatttagataaaataaagaaacttgtttctaacagtgactttaagaattattatacagaattttcacgtgatttatcattattgtcaggaaaattacagatacatttgaatacagaagataaatttctatatcctgctcttttaaacaaagaagatttaaaagaaaaaactcaaaaatatattattgaaattaaaaatcttttgaatgactttactgagtataagaataaatttaatactaaaagtaagttaatgaattatgatgaaacttttataaaaaaggaaactatatatatgataaaacaaattgaaagtagaatgataaaagaagaaggggatatatatgaattatgctaatcttcaaaaaataagaaatggtaaaagaacttacagtattactccacatattccaggtggatttattaccattgacactatgaagaaaataactaatgtttgtgaaaaatacaatggtgtattaaaaattacatctggtcagagaatattgataactaaccttagagaagaagacattccttttatatggaatgaactagaaatggaaccagctgttaaaagtacaaattcagttaaaaatgtagaaatgtgtccagcaggtttttgtaagagagaaaagtttaatacaattagtacaggaatgaaactttcgaaaaaatatacatggatggaaatgccatgcagaactaaaataggagttgctggatgtagaaatgcatgtggaagtgtatatagtaaagatgttggactaatagctgataaaactggatttatagtatgtgcaggagggtcaggtggatataatcctagacttgcagatgttatagctaaagatttaactgaaaaggaagcattaaaaatgattgataatatatttgaatactataaagaaaatgccgagcctggtgaaaagttaggcttttttatagatagaataggcttagataattttaaacttaatatttgtaaatgatgtataaacaaacctttaaaaatattaaaaggtttgttttgattttttaaaaaaagatattataatgagtaatgtaatatatattaaagaattaaaataaaaaataaataatttacaattatgattatttattaaaatatcttgctaataatactataatatagtattatacatatgtacttagtttattatttaagtatgttttagcaaagttagagaaatctagcgacgcaaagctatagggactaaggttgtgaaaactatgtcagccagttgccgaagagtaagttctattctttgtagttaagaatttttgaatcactctttttgagtgttttttttaacgatcaattaaacttttatcttactataggcagattttctaattataggaggaaaagatatgataagaagaaatatattatgattgaattaataaaatttgttttaaatttattggtagtagttaaggatatggataaatcttcaactaatggtattatttaattgataatataagagaaatttagagatgttaattatatgaagaaaattaaaatttctaaaattagagagaataattatgagttaacatgatttatataggggtatgtaaatcaaaattataaaatgtaaataaaatttaaagttaaaatgaagcgagagttttataactctagctttatttttatgtattatagtatatgttgtaaatggaattttaaacttctatttgtatttatataaaaataataaaaactgctttattatgtttgaaaaacatgatattctatatgcggcaataaaatgattaggagataagagaaacatatgacaaaagatatgacgtctggtaatccagtaaaattaataattatattttctatacctttacttataggtaatgtgtttcaacaattttatagtatggttgacactattattgttggaagatatttaggggttgatgctttggctgctgttggaaatacaggatctatggcatttttaattaatgggtttattgtaggtcttactagtggtttttccattatggttgctcaaaaatttggagcaaaagatgaagaaggattaaaaaaagctgtgtcaagttcaataattttaagtgcagctgctgttataataattacaataataagtattttaagttcaaaatttctattaaatctaatgaatacacctgcaaatataattgatgattcgttaaaatatattaatataatatattctgggactattgcagttttaggttataacatgatttcaagtattttaagagcactaggagatagtaaaactccattatattttttgatagtatcatctgttctgaatataattttagatttagttttcattgttaatttttccatgggagtaagtggagcagcatatgcaacagtaatttctcaaggtatatctgcaatattatgtttggtttatacattaaaaagatataaaattttaagattaaaaaaggaagattttaaggttgagaaaagtatttttagaaatcatttaaaaataggtattccaatggcacttcagttttcaattacagctataggaataatgatagtacaaggcgctttaaatgtatttggatcagttgtaattgcctcatatactgcagcatcaaaagtacttcagattgttatgcagccggcaataacattaggagttacaatggctactttttgtggtcagaatcttggagctaaacaatacacgcgtataaaaaaaggagttagaaagtgttctgaaatttctataattacaagtgttgttgcagcagtaatacttattttaggtggtaaatattttgttggactgtttattgataatcctagtgatgaaattttatcatatgcacaacaagtatttaattattcagcatacttctttattccattaggtctcatatttgtatatagaaatgcacttcaaggaattggagaatcgtttattccaatgatggcaggtgtatatgaacttggtgcaagagctttagtggcatttactcttcctaaatttattggttttactggaatatgtttatcggatcctttggcttggattgctgcagcagttcctttggcttatgtttattttagaagaataaatgtgttaatctctgaacataatgtacaggcgaataattgatcagattttaataattataatgggaaaaagtaaataagaaagaaaaataaaatggactttatataatagacactaataaatggtgtttatgtatataaagtctttttttatatatagatttgtaaaaaaataaattaaaatttgaaatctatagtattttaattattgataatcaggctaaaattactataaaaatagataattcaataatgtatttgtttacattattgaattaaattaaaatttcatatttgatttctttataaaatttctcctaaatatgttatttagatatctttattacaaaaatggacattttattttaaattagttctttttgatgttataatatttaagggaaaatgttaaatagtagtataaattatattgacgtaaatttaaggagaataataaatgttttttgacaaaatgaaatctattgattctaaaaaaatttcattaattacaatattgaacattgtaattttttatgtactttacagggtggctatttttattgctaacaatacaagattttatgaatggtttctaatttcagatatagttagcataactcttgttgtagggttaatttcaatttttagtttttttctttatagtagtgtttatgatgatgattattttcatatgttttcacttatgtacatatcaatttattttgaatttgtaatgatgacacttctagcacggtctcttaatgtatttggacttatggaggtaaataagatatttgtaggttttgcatcaatttttagaacaataataatatggcttacatattacgaacaaaatcctataaatagatatttacataataataagatatatgcagtatttttatctattataattacatttatgtgcataatgactgatttatatttaatgacatgtaatgtcttaaattcgcatatgccattaataaattcgattaaagtatctgttaatatagcaacctttataattcttattaaatttagtatacaatatgtaaataaaaagaatgtaaattattttataacatttttaggtacagatataatgttttttagtagagtacttttaatgtctaatctatatcctgataaatatacaatgtatgtactaaatagaataatattatgttgtggttttgctattatagttataagtatgttttgggaagtcataatgatgtctaaagaaaataaaaaattaattaacgactttaacactcaaaaactagagattctaagactaaaacatgaagaagaattgagaacacaattttttgctaatatatctcatgaattgagaactcctttaaatattatgatatgctcatttcaactacttgaaagtaaaagtaaggataaagattctttatctgaatattataaaaaatatgaaaaagttatttcagaaaattcatcaagaatgctaagacttattaataatataatagatgcaagtaaatttgaagctggatgttttaaaatggattttgctaattgtgaaataatacgtgttattgaagatataacattatctatagcgcaaagtgaaaaatctcaaaaaagaaatataatatttgatactaatacagaatttttggaaataaagtgtgatccagaaaatattgaaagagttatgttaaatcttctttcaaatgctataaaattcacagataatgatggtgaaattatagtgagttgtgaagaaaatgaagactacttagttataagagtaaaagataatggaatagggattccacctgaatttcgtagcagaatttttgaaagattcgttcaagtggacaagtcatttagaagaaatgttgaaggcagtggtataggattatccattgtaaaatttatagttgattcacatgaaggagaaatttatattaatgacgaggttattaaagggtgtgaatttgtcattaaaatacctaatgtaaaaatagaaaatgatatagttgtcaataattataataaagaacttaaaaaagaaattaatgcaaaggtaaatatagagttatcagatattcaataaataaagtatatctttaaattatatggtattattcttatttataatgtctaatatgtagttcttaataagtaaataatgagctaggttaaataaattcttttaagaaatgtaacctagctctatttttatttggtgttatttattatgcatattactgtaaatatttaactgattttgattatatatttgctccctctgtttttattataagaatttgaaaaattgaattttagaataattttataaaaaattaactacaagtttaatacataaattataattaataccagtttgaattttaaaaaataataaatttcaaaatatcaaaaatgttattttgcatatataagtataatttaaaattaaattatttgttagggagtaaatttattatatttacataaatgagtatatttacaatataagaaagatatcttaaaatgataatataaaaagtactcaaaatatagaaaatgagtactttttattattgctttcttaaaagccttgaaatataatggttatacagaaaaaaatattttttataaaaagtacctgtgtgaataatgagcactcaaatttatacaaacaggtacttaaaataagtaaactggcagtaaaataatttattgaaggaaagtaaaatatagatattataattatatatttaatattcagattaagataaaagtaaatgggagtacatatggaagagatattaatagcagttaaaaataaagaaatcgatgaagacagtgcattagatattatgctagaattcattgagaaaagtaaggaaataaaagttaaaaatatattaaaactcttatctaagaacttattgtcgttagaaaatgcatcaaaaatgataaatgcaatgagtaacttaaatgattctaaatataataatgcgcagaaatccaattattatgaggatgatataagtaattttaagttatcatctaaaaagtcaatttccaatgtaaaagaacttaaaactaaacaaaaaagagctgcaaggcccctagaaaaagaggaatatgatgaaattatggaactttgcaaaaacggttttgaatattatgataatggaaagaagagaaaatttagacctaatgaacagcttgcaatgacatttcttcttcaagcaaatctagggcttagaatttctgatgttcttacacttacaccgtcaactttaaaaaatgataagctagaaataatagaaaagaaaacaggaaagcttcagtatagggatataaataaaaatctaaaaagtataatatacgaatacgccttagagcataatattaaagctgatgaatatataataaaattaaaaagaagaggtgtacacaaacagctttctattattactaattacttaaaattgtcaaacataagtagtcatagctttcgaaaattatatagtatgacagtatataattcaacagatggtgatatagagttacttaaggaacttttgaatcatagcagcatagcaactactcagaaatatataagaagaactcaagatgaaataaataaagtaagtgcatcaattgatttcacatattcatggtaagtagtctgaaataaaattaatgtttttagattacaaaattttaataagagattatagatattatttttctatagtctcttaattacgttttaaaagtggatattttatatagaaaatcttaacatataaaatatttcttaatttattttaggttttaggtagataaatttgggacaatattaatgacaacttaagtaaaacttaagaagtttcaactaaaataaaagcaaaagcaattatttggtaagttatttatatgaaatttggaggaagaaaaatgaaaactattgaacttattaaacttaaacctaagaacataagctttaagaaaataaaacacaaaaaaacaattatatttatggttattatattgataattttttcagttataggtgtaattatgttaaaaccaaaagatactattgtaaaggattatacaaaacttgaaaaaagcgatattattaaaaatgtaaatactcttggtactatcgaaagcaacgataagataaatgtgtattctacactgaataacgtaataaaagaagtaaaagtccaagctggagataaagttaatgaaggggatgtactttgtgttcttgattcttcagttttagaaaaagaaatagctgaagcaactagtacattagaacatgataaagaaaaagctaaaattgaactagaaggtaaaaagcaggcttatgacaatgcttcttacatatatgaaaataatatagattcatctataacagacagtaaagaagctttaaatacagcacaaattaaacttaatgatgctcaaagagattatgatcaaaaaaagactttgtatgataatggtgcagtaagtcagtcggatctagataatgcaaagtctactttggatcaagctaaatctgattatgacaaaagttctgtaagtttagaaaatgcaaaagttaaagcaaaagaggcagtcaataatgcaaaaaatgaatatgattcagctctaattgaatacaataacaataaggatgaaatatcacttaaagggaaaaaggatgatcttgataaatgtgtaattaaagcaccagcaagcggaactattactacagtaaacgcatcagtaggaaatacttctcaaggagttttatttacaatagaaaatcttgatgatcccattataatggttaatgtaaaggaaatagatgttaataaaataaatccaggacaagaagttgaagtaacaacagatgcagcacctgacgataaatatgcaaaaggaaaagtattgagtataagtgatacaataaaaacttctgaaggcacttttaatacaaattctaatagtgataataaaagcggaacaaatagtacaagctctcaaggatttcaagctaaaataaaattggataatcctaaagagaatgattttataaaagttggaatgaatgcaaaggctaatataatattagataaaagtatgaatgttttttcagtaccgttttcaagcatattagaagaagagagtggaaaatatataaaaattgctaaggataataatgataatacatatacagtatgtaaacttccagttacaactggtttagaaactgatgtatctgtagaaattgaaaatagtgatttgactgaaggagataatcttttattagatccttcactttatgaagaaggacaaataataaaattagttccggctgatggaggtcaagcttatgaataatattattgacatgaaaaatataataaaaagtttttatataggaactccaaatgaattaaaaatattaaaaggtattgatataagtgtaaaacaaggagaatttgtgtctatagtaggtgcatcaggatcagggaaaagtacgcttatgaatataataggcgcattggacaaacctactgatggcacatatgttttagataaaattgatgtaagcagtcttaaagataacgaattatctgccattagaaataaaaaaataggctttgtatttcagacatttaaccttattcccagaagtagtgcattaagtaatgtagaattgccaatgctctatggaggattaaataataaaagtagaaaagaaagagcagaaaggctcttagagcttgtagatatgaaagatagaatgcttcataaaccaaatgagctttctggaggacagaaacaaagggttgcaattgcacgagctcttgcaaatgatcctagtataatacttgcagatgaaccaacaggagcactagattcggcaacaggtcgtcttgttatggatatatttcataaagttcacgaattagaaggaaaaactatagtttttataacacataataatgaacttgcaaaagaaactgaaagaataataaccttaaaggatggtcaagtaattagtgatgaaaaaaatttgaactacaaaaagaggcatagggagagtgatacattgtgtttataaaagaaaatataatgctcgctatagcaggccttaaagctaacaagatgcgttcacttcttacaatgctagggataattataggtatatcatctgttatatcaatagtatctatagggaactcaatgacttctgctttgaatgatacactttcacagcttggagcaagtaatataatatgtcgtattatgcctagagataataactggaatgcaagtactgaagatgatgatttgttttctgatgaagatattgataaaatcaaatcaaattttaaaaataaaatatctaatatatctatttcaaataactatacaaatggaaccattaaaaaaggatatactaaaacaaatgtttctattgtaggtgttaatagtgattatgataaagttaataatgtaaaaataacaaagggacgttttatatcaagtgatgatgtcaaaggagataaaaaaacagcagtagtatctgataaatttgtgaaaaatgtttttaaaaataacgaaaaccctcttggaaaagaagtaaaaattacaagtggagataatatagaaagctactatatcgtaggaatatataaatatcagacaaatatgtttgaaagtatgggaatgaattcagaaagtgaaatgcctacagatttatatacaacaatttcaagtactcttgagacttcaaaattaaaaaattatagttttatgactattcagcctcaaaagggtattgattcaaggagtctttctgaagatttgaacaagtattttcataaactttataaggacaataaaaactttcaggcatcagcatatgcattagaaaatgaagcagagtcaatgaataaaattcttacattagtttctcttgcaatatcagtaattgctgctatttcacttcttgttggaggtataggagtaatgaatataatgcttgtttcagtaactgaaagaactagggaaataggtacacgaaaagctttgggtgctcgtaattatcatattcagttacagtttattacagaagcagttataatatgtgctataggtggtgcaatagggataatcttgggtgtttcaactggtgcaataataagtaagataataggaacacctgttgcaatttctctaataactataattatcagttttattttttcaatgacaataggtgtattttttggattttaccctgcaagaaaagcagcaaaacttgatcctatagaagcattgagatatgaataaagaatccatattaatttatatatctaatggaaattaacatatataaaaaatggatagtaaatagaatattaagtattggtcttttatatcaaaaatgtaaatataaaaatatattttatttaaataattattgtaaaaaatgatatacagtgttaaaatatgtctgggtagtatcttatggagctataccagacttttttcattagaatatacttacaactcatatctatgcgaatgagattgaaattaggatgttgtatcactttaaatggaggtgatactataaaaatcgggtttattggtcctgggaaggtaggcgttaatttaggacgttactttactcataaaggaataaaaatcagtggcttttatggaaataattccaaagaagcttcagaaataacaaattcaaaatcatatgacaattatgaagaaattataaaagacagtaatatattatttataacaacacctgacgatatcatttcaatcatagatagagaaatttcaaagtttgatttaaaaaacaaatctatatgccatgcaagtggttcattaaaatcaactattttatctaatgctaaattatctggtgcattaatctattctatacatcccatgtttgcattttccaataaaaatatgtctataaaaaaattagagcaaatttatttttcaattgaaggtgatttgaagaacgaaaacattaatgattttgctgtgattagtcttatgaatcatattggtaacaagtattttataagaaatatcgaagactcagtaaaatatcatttagctaatgtttttgtatccaatcttgttctttcacttattgatattggtacaggctatcttaaagagcttggacttagtgaagaacatgcattaaacgcattatttcctctaatagaaggaaacttagaaagtattcataaaaacgggtttgttaaatctttaacgggtcctgttgtaagaggagatattaaaacaataaatagacatcttgagagtctaaatgatgaagatacagaattgtacaaatcattatcattaaatttattaagacttgcagaaaagcaaaattctaatattgaagaaaatcattgcttgaatcttacaaatggcaatgaggaaaatgcattgaatacatctaaaaaaaatatggagttattcagattattaggaggaatagaataatgaaaaatacagttttgacgttccaaaaggcaaaaaaaaatggagaaaaattatcaatgcttacagcttatgattattcaatggcaaagatcatagatgaaagtggcataaatggaattttaattggtgattcattaggcatggtagttaagggagatgaagatacattaggagtaacagtagatgatattatttatcacactaaagctgttaaaaaaggggctaagaatgcacttatagttagtgatatgccatttttatcatatcatgtatcagttgaacaagctgtcatgaatgctggaaggattatgaaagaaggcggggctaatgcggttaaaatcgaaggtggcaaaagtgtagcaaagcagattaaagccattgtagaggctcagattcctgtaatggggcatttaggattaactcctcagtcaataaatgcatttggtggttttagagttcaaggcaagagtgaagaagctgcaaaaagattaatagaagatgctaaagtgctagaagaggctggtgtatttgcaattacacttgaaggtattccagcaagagttgcacagattattactgatactgtaaatgttccaacaataggaattggtgcaggtaaagaatgtgatggacagatacttgtttatcaggacatgcttggtatgtttagtgattttgtacctaagtttgttaaacaatatgctaatattggttcagttatgagagaatcaatagaatcctatattagtgaagtaaaggaaggaagctttccacaagaggttcatacttataaaatcgatgaagaagaattaaaaaaattatattaatattagttaaaaaatataatatgatttttatattaaataatagaagcaataaatagttttaagctatataagaaaaggatggggaatatgttattaaaaaaagttgatgaagtaagaagtttagtggaacagtggagaaagcaaggtcttactgttggatatgtccctactatgggagcacttcacgaaggtcatgaaagtcttataaaaaagcagtaagagaaaatgataaagttattgtaagtgtatttgtgaatccaacgcaatttggtccaaatgaagattatgattcttatccaagaaatatagaaaaggatatggaattatgtgaaaatgctggtgcttgtgctgtatttaatccagaaccatctgaaatgtactttgaaaataaatctacagtcataagcgtatcaggacttacaagcgttttatgtggtgctaaaagaccaggacattttgacggagtatgtcttgtagttacaaagttttttaatatagtaaaaccaaatagagcttactttggtgaaaaggatgcacaacaggttgcagtattaaaaagaatggtaagggatttaagtattgatgttgaaatagtaccatgtcctatcataagagaagaagatggtcttgcaaaaagctcacgaaatacttatttaaatgttgatgaaagaaaagctgcagtggtattaagcagaagtttaaaaatagctaaacaattacttgataaaggtgagaggaatgcagctaaaataaaggatgcaataatatctgaaataaatactgagtctcttgcaaaaattgattatgttgaaatagttgacagtgaaaatttgacagatgtatcaactattgaaaagaatattcttataccaatagctgtttatataggaaaaacaagattaatagataatttcacctatgaagtttaagaaaaacatattaaataattttaatttataagtacatctctaggaggaaaaaagatgatattaacaatgttaaaaggaaaaatacacagagcaacagttactcaagctgaattaaattatatgggaagcataacaattgataaaacattaatggaagcatcaggcataattgaaaatgaaaaggttcagatagttaacaacaataatggtgcaagacttgagacatatgtaattccaggtaagagagattccggtataatatgtttgaatggtgcggcagcaagacttgttcagccaggtgatcaggttattattattgcttatgcacaaatggaagaaaaagaagcgaaagaacacaaacctaaagttgtttttgttaatgatgataactcaataaaagaaattactaattatgaatataatgattaatttgtaatataaataatattattttaaataccacaaagttcaattatttttttgaactttgtggtatttttttgaactttgtggtatttttttgaacattatgatagaaatttaatttttaatatgataattatttctatttggatataaattataattatttaagtgaatttattataaaacatattcactaataatttgtcctatttttacgatatcggaagtacctttaaattcaaatttaacttttcctagtgcgctaaagtacatttcaagttcactgtctaaatcaaaagtacctgctgtttcaatagagtaagcttgaacttttgaatatggaagagatgtaaaatctttttttgaacctgtgattccttgaacattgacagctataactctcttatttgtaaatactacaaaatcacgaattgttttataagagcttatcaaacattcaccagatataagtaatggtgtaatttgattgattacctcttcgtttgaaattttcttaagttttaaaaaatcactatttttaaaatcaatcatagtagcctcctaaaataaatagattctctataattgtaacatacatacaaatgttatagaacttaatttgtattttaccataagtttgtcgaaggaaagtttttgaaaaatatcataaaatgtagaattctaaggaataatatgttaatattgaatcatacaaaagacgattcctcggaaaaacctacaataccaattaacagcaggctaaacatccctattggcttgctgtattttttattttaaagactgttttaaattattaaatcttcttttttcttttgataagtaagtctccctgtgataaaataatactggttttgacatattaatgaatttaatatattaatatcataaatcattaagatttattttataatttcaaatgataatgtataaaacccataaaaatagttaagaatttagcaaatatattattataaagttaaattatgagggaggatgttgtttatggctttaacgcctatgatggttgaatatatgaagactaaggaacagtataatgactgtatcctattttatagattaggtgacttttatgaaatgtttttcgatgatgcaattactgtatctagggaattagaactcgttttaactggaaaaaactgtggacttgaagaaagagcgccaatgtgcggaataccacatcatgctgcagctgcatatattccaagacttgtaaacaaaggatataaggttgccatatgtgaacagcttgaagatccaaagcaagctaaaggtattgtaaaaagaggtgtcgtaaagataataactcctggaacttttgttgattctaattctaatttagaaaatgacaatacatatctaatgacaatatatgaagatgttgagaaaattggaatatcaacatctgatataagtacaggtgaatttaaaacaacatcatttaaaaatatacgaatgagtcttttggatgaaattgccaaggtaaatccaaaagaaatattacttgatgtgaatgcttctgaaagtcttataaatgatataaaggggataagcagcgcccttataacaaaaaaagatttttcggattttattgtttcttttgatgaacttaaagaacaattttcagatcttgaagtcagtggccttgataatgaaagagaattaacaagcagagtacttttaaaatacataaatgagactcaaatgatgagccttacaaatataaaccttttagaacaatatgaaattatcaattatatgactattgatagtaattcaagacgtaatcttgaacttacagaaagcataagggaaaaaacaaagaaaggttcacttttatgggtccttgataaaagtgctacaaccatgggggaagaaccttaagacgatggattgatgaacctcttataataaaatctgaaattgaaaaaagacttagtggtgttgaagaaatatttaattcaataagttttaatgatgatttaagaactgcacttaaagaaatttatgatattgaaagaatagtcggaaaaatatcaaatcagaatgtaaatgctaaagatatgctttcactaaaatcttcattaagcagaattccagaaataaaagaacttttaaaatatgcaaaatcacctcttttatgtgaatattacgataatcttgatactcttgatgatgtaagagaccttcttgaaaaatcaataaaggaagatccaagtcttacaataaaagaaggtaatataataaaagatggatataatgatgaagttgatgaacttcgccaaagcaaaattcatggtaaggaatggattgctgcacttgaaaatcgtgaacgagaatttactggaatcaaatccttgaaagtaggatacaataaagtttttggatattacattgagataagtaaagctaattttagttcaattccagaaggaagatatataagaaaacagactttgacaaatgcagaaagatatataactgaagaacttaaagttatggaagataaaattttaggatctgaagaaaaattaattaatcttgaatatgctttatttatggaagttagaaatgaagttgaaaaacatatagcaagacttaaaaaaagtgcaaggataatttcagacttagatggtgtttcaacacttgcattagttgctcttgaaaatgactatgtaaaaccagaaataaatgaaacaggaataatacaaataaatgaaggaagacatcctgttgttgaaaaagtaatagggcgcggtgagtttgtatcgaataatacaatcttaaatgatgatgataaagaacttcttcttataacagggcctaatatggctggtaaatctacatatatgagacaggtggcattaataactctaatggctcagataggatcttttgtaccagcagtatctgcaaatatttctatatgtgataagatattcacaagaataggtgcatctgatgatcttgcaggtggaaaatcaacatttatggtagaaatgtgggaagtatcaaatatattaaaaaatgctacaagtaaaagcctagtccttttagacgaagtgggaagaggtacttctacatatgatggcttatcaattgcatggtctgttattgaatatataacaaaaaatgagaatctaagatgtaagacgctttttgctacacattatcatgaacttgttaaacttgagggaacgataaaaggagttaaaaactattcagtagccgtaaaaaagaatgaggatagtgttatattccttagaaaaattattgaaggtggagcagatgaatcatatggtatagaagtcgcaaaacttgctggacttcctaatgctgttattgagagggctagagaaattttagaagatcttgagaaggcaaataaagttgatataaacaacctttcatcgtatgaaactactattaaagagattgctattgatgatgatttatacacaaatagtttaaaagactgtgttaatgaggaaatacaaaattcagaagggtgtataaacgaaatagaaaaagctctaattgataaagttaatgaactttcatttaaagataacaagttaaaagagtatgaaaataagattcaggagtatatacaaaatatttctgaacttgaaaaagaaataagtgttctaaaatcagaaattcataaagaaaaacatattcataaagctaaaagtgatattaaaaatgacacaatgcagataaattttgattcatttgaaaaagatacatttataaattcaataagtcaaacagatattttgagtttaaatcctatggaagctatgaatttgctttataagctagttggagaagctaaaaaattaacaaaataattaacagtattaaaaacacagataatttctatatatgtaaaattatctgtgttttctttatgaatttatgtaaatatattataatatttatgaagactttcaaaataaaggagaaaataaaggagaaaataaatgaaaaaggttttttcagaaaatgaacaaaaattttatacagataaaatattcttagatatttttcatgaacaaggaattggagaagctgaattagaaaaagctatctgtgaaacttataatacagatgaaactgagtatttaagaataagtgatattccaatggatatgaagattgaagctataactgatacttgtcaattatcaggcttgtcatttgatgattataatgatattttaaattatttttatgacaaatataaaaacaactaaaaattataataaagattatatatttcagccacactaaattagaaatgtatctaattttatgaaagtggtgaatttatgtttaatgttccattaatagaatatgtaggatatgcagcatcaattttaattggtatatctatgtttatgaaaaatatagtaaaacttagatttataaatttaatcggatgtattttattcacaatttatggctttataataaaagcatatcctgttgctatcgttaatttaataatagcattcacaaatatatattatctttataaattaacaaaagataaataagctataatcccagagttgattttttcatctgggattatagttttcgcactttattaatacgaacattaatacaattaaaagattatatattacaataaatttaaaaataacgaaatagatttaaaatttataatacattattcgaaaaatcacttgaaaaaagtcgaaatataatttactataaataagtgacaatttgatatacgaaagagtgagactatgaaaaatttatttaaaaaaaatggtaaattcgataattatttcggaataagcgaaaataatacgaatattaaaacagaaatgattgctggtgtgacaacatttatgacaatggcttacatacttattgtaaatccatctatattgtcagcagcaggaatggatagtggtgcagtatttagcgcaacagcattatcggcaattgtagcaacacttattatggggctatatgctaagctaccatttgctcaggcaccaggtatggggttaaatgctttctttgcatatacagttgtacttggcatggggtattcttttcaatttgcattaacagcagtatttttagaaggtttgatatttatattattaacattatttaatgtacgtgaagcaattgttgattcaatacctgacaatataaaaaaagctatttctgttggaataggattatttattgcattaataggacttgaaggtgctggcataataatacacccagaagatgggggaacaatacttgctttaggtaacataacaagtggtcctgcactattagctattataggaattttattaactggtgttttacttgtaagaaaaataaaaggtgctttatttatcggaatgatagttactgcaattattggattatttatggggtaactccaatgccaacaagtattataagtatgccaccttcattcacttctttattattccaatttgaatggcataatattttttcaattgatatgcttatagtattatttactttattatttatggacatgtttgatactataggtacattagttggtgttgcaactaaagcaaaaatgcttgataaagatggtaaagttccaaatattaaaaaagcattatttgctgatgcaattggtacaacattcggtgcttgcgtaggaacaagtacagtaagcacatttgtagaaagtgcatctggagttgctgaaggtggtagaacagggcttacagctatatcagctgctgctatgtttggtctatcattattttttgcaccactttttgcaagtataacatcagctgtaacgtgctgtgcgcttgttcttgttggattatttatgatagaacctattaaagaaatagacttaagtgattatacagaagcaataccagcctttttaactattataatgatgccacttgcatacagtatttctgatggtatagtatttggtgttatatcatatataatattaaaagtgtttgcaggaaagagaaaagaaataagtattacaactattatagtagcattaatatttatacttaaatttttaatataatattattgatatataaagaagcagattgaaatagtaagtttcattctgcttcttttttgcttatatttaatcattacttttactatagttgttttcatcaagaagcgcagtaagtaattcaatatggtacttttcatctttaattatgcgctctagtacggctcttatgcacatatcatcaataatccttatatgttcctcatattgccttatagccttatattcatcattaatatcaagaagtatcatattaacataattagtaccaaactctacaaacttaggagtccaatatgaataggaaccattatcataatagctatagcttaaatttcctcctaaaagagtaataagttctccaatcatctgcatgtgcatcatttctgttttagaaatagaaagaatagtttcagaagctttacagtatttattatttaagcgaatttcatggtttacatactggcttattgctgtgaattcagaaacattgctacaaaaatcctgacttaatatctttgcatattcttcatttttgtttttaacttgtattttaggatatggaagattaatttttgctggaagtacattttttaatgagcatttctcttgaattttacaagataaattatcaataagttgttgttctcttaaataatttccagtcagtgggatttctctttgtttatttaatgcttttttagtcttattatttgtctgattacgttttttacgtttagtcataataaaaactccctaattatacatctcattttcaatatatagattaagtacaaaaaacgatacactattactaaaaataaacaattaataaatctatatagtctactattttctgttttttaaaatatagcaatattctttaagatatagtttaatatatgttccttttattgtatatatatttatatttcttcttgataattaataattatgcattttgtaaaaatatgttttataataagtatgtaattaattaagaaagggagaaaattatggaagatattgaatatagatatataaattttgataatgcattatttaaacaggtaataaatttgagatatgatattttatttaaaccatatggcaaaattcaaaaatatacatatgatcaatttgatagttacagttatcacttagttggaataatagataataatatagtttcatattcacgatttactccattaagtagggacaatactgtaggcaaaatatcaaatgttgttgttcatcctgattataacaatatgggaataggaattgatatgctgaaaatacatattaaaacctcattagagaaaaaaataaaaaaaatatatcttaatgcacgaatagatacaatagaattttataaaaaggcaggtttttttactgaaagctcagtgtttatatcagataaaagtggactaactcttcaaaagatgtttttaaaagttgattaattgacacaaaaactaaagcttctttagattatctttataatttctgttatatgttaagctaatgtacaggtttgtatattataaataaatatataacatattccaaaatatatagtatatgtaataaaaattataactgatataatgagaggggattttaatatgaataaaacagcaaaaggattaattacattttccttagtaactgcaaacatgttatgtgtaggaggaaaatatgatctttttacaacagcagcttatgcatcatctgatgatgctgatgaaatatcagaacttgatattgaggattctgacggtgatgcattagatctttattctgatagtgattatgaagatgaaattgatgatgacttagaagagggtgaaacgtattatgcggaaagtactactaataagattacaattgatacaagtgatgtagatgaagactgcatacgtatatttgctaataattcagaatatgagcttggtgataaaataaagctaaaaagtgggacaaacactataaaaataagagtatatgaagatgaatatgatgaagatgagaactactctagttcagattataatcagtatacaataaaagttgaatatgataatgacgaagatagtaatggagaattatcacaattagatttagaagacagtgatggtgatagcatagatttatattctgacagtgattatgatgaagaagtagatgatgatttagaagaaggtgaaacctactatgccgaaagtaatactaataagattactctaggcacagaggatgtagatgatgattatataagaatactctataatagtaaagtttatgaattaggtgattcaataaaattatcaagtggcacaaatacattaaaagtaagagtttatgatagtgaatatgatgaagacgaaaattacagtagttcagattatagtcagtatactttaaaaataaactatggcagtgattcagacaatagcacttctgatgtaggtttgagtagtatttcattaagcagtggatctttaactttcaataagaatacatcttcttataatataaatgtaaattctgatttaaatagcatttctgttgaagccataccagaagattcagattatactgttaaaattaatgattctacagtttctgactctgattattattcaaaaaaagtaactctaacagatagtgtaacaccagttattattaaagttacaaatgatgaaaatgaatctaagagttatactgtaaatataactaagactaaaaaagaagacacattagcaatgactaatccatatactcaaaataataatacaccctcttctgtaacagtatctcaatctcataatactggatggataaatgtaaataatatctggaattattattattcagatggaagcaaggctacaggatggatacttacaggtggaaattggtactacttaaattcaactggacaaatgcttacaggttggtttttagatagttatggaaaatggtattatttatatgaatccggagctatggcagttaatactaccattgatggatataaaattggtccttctggtgcatggatgcagtaaatttatatgatttaacataaatataaaaattaaaggatattttaatatacttatataaaaagcagaatgattaagttttattttctaaatcattttgcttttaattgtttttgagtggtaaactattatataatacatttgttattaaaaataaatacgatagataattaatgtttaaataattatgtggcttttaaattttaaagctcatagtggaacatacatgaattatgtttaaataagtgaaaggagggatatttacgcttatgaaaagaattaacatattaaatgaagatacagctaataagattgctgcaggagaagtagtagagagaccttcttctgtagtaaaagaattagttgaaaattcaatagatgcagcttcaaaaaatataactatagaaatagaagatggtggcacatctctcattagaattatagatgatggtgatggagtatttaaggatgatataaaaaaagctttcatgccacatgcaactagtaaaataacaaaatctgaagacatatataatataagtactttaggttttaggggggaagctcttccttcaattgcttcagtagctaaagtaaacttaaaatcaaaaacagcaaattcagagtatggatatgaaataaatattgaaggtggcaaatttggagatgtatatgaatgtggtacaaataaaggaacaataatagaagtaagagatttattctttaatgtacctgcaagaaaaaaatttttaaagtcagtttcaaaagaaggatctttaataaatgatataataactagaatcgctctagcaaatcccgacataagttttaaactttttaataatcacaagaaagtaatacatacttttggtaataatgatataaaagatacattaagaactatttatgggaaatctataactgataacattatttattttgaagatagcagtgatttggttactatacatggatatgtaggaaaagaagatatcgctaggggatctagaaataaccaaagcatttttgttaataaaagatatataaaaataaaagtcttgcagtagcagtagaacaggcatttaaatcattttctacagttaataaattccccttttttgtattattcgttgaaatttatcctgaatacgtagatgttaatatccatcctacaaaagcagaaatcaaatttaatgatgagcgaatggtgtttaaaaagattttttcagctgtacacaattctttaaagaatgatatttttgaatcatttgcaatagaagaggaagtaaaatctgaagagacagttcagccatcttttgaagaaatatcctttaaaattaaagaagaagaagaaaaagttaaacttgcaagtaatgctgcaaaagaaattttaaataatggtggggtattaaaggcagataactcttttataaatagtcccttatttaaagaagataaaaaggactttgttttaaaagatagctgtgttatagataatagtattgatattccggtagatcttaagcgtaacgttaataataacaaggatgcttacaataataatgaaaaatcgtcttttgaaatgacttctaacaacaatattgtagaatctcatgttattcaggaagaatcttctagtagtgagttatcaaaaaatgctgataatagtgttttagatcaagatttacagaaagattcagatactattaattatagtgaaaaagtaaaatataaagaaaaaattgcaaaatttcctccaatatcaataataggtcagtataataaaacatatatcttaggagaatatgacggaaccctttatatgattgaccagcatgcagctcatgaaaaaatatattttgaaaaatatctaaaagatattgagtctggagatataatagttcagccactaatgataccaagcattatagatttgacgattgatgattattcatattttgaagaaaataaagaaatattcaaagatgcaggatttattttagaggaatttggaggaacgtcaattgcattaaaagaagttccatactttttaggtaaacttaatcctaaaaaactatttattgaaatacttgataatttgaaaaatttaggtaatggaaaaactactgaagtaaaacataacgctattgcaacaaaggcttgtaaagcagcgattaaaggaaatgatgaacttcaaataaatgaaatggttaaattgattgaggatttaaggtatatagatgatccgtttcattgtccacatggaagaccaattataataaaatttacaagtacagatatagataaaaaatttaaaagaatagtataaaaatatagatacctaaatactatttattttagtttggagaggaaataaacttatgaaacaaaaactattagtgcttggtggacctacagctgtaggtaagactgagctttctataaaacttgctaaagagttaaaaggagaaataatctcagcagactctatgcagatatataaatacatggatataggttctgccaaggtcacagaacaagaaatggatggcattaagcatcacttaatagatgtaattgagcctaatgtacctttttcagtagcagattttaaggaatatggagaaatagccttaaaaaatatactttcaaaaaataaatttcctattattgctggtggtacaggactctacataaattcactaacatgtaatatgacttttacagaagcagaaaaagatgaagaatatagattgtaccttgaaaaattatcagaagaaaaaggtaatgattttgttcacgaaatgctaaaagaaattgatcctataagctataaagaaatacatgcaaacaatagaaaaagagtaataagagccttagaagtatataaacttacaaagaagccctttagctcctttaatgctggtgaagatttctataaaagtgattatgatgtctactattatgttcttacaatgaatagagataaattatatgaaagaatcaataaaagagtagatataatgattgaaaagggccttcttgaagaatgcataaaattaagagaaatgggttatacttcagatatgcaatcaatgcaggggataggatataaagaaattctttattatcttgaaaataaaatttcatttgaagatgcagtaaatatgataaagcaaggctcaagaaattatgccaaaagacaacttacttggtttaggcgtgataaacgatgcatattccttgataaggatgtaatgagtgaagatgaaattttacataaagttcttaatgacataagaaataactaggggtataattatagtgtactagtaaaatatgggaggtgttgtatttggtcaataaaacagttaataatattcaagatatttttctaaataatgcacgaaaaaatagaactaatttaacagttcatttattaaatggttttcaaattaaagggattgtaaaaggatttgataattttacagttatcttagaatgtgatgagaatatgatgttaatatataaacattcaatttcaacaataacacctgaaaagccaataccttttattaataattaatatacattataaataggcataatatgcctatttattttttaaactgtaataaatattgctatttattacaagaaatatgtagggaaatatttttaagtattgatatgatttttatttaaagatatactatttaatatatagcaatggagctttggtttgaaaataccagagctctttttttactatactttataaattgatttcaattaaggagagaatttttatggaacctacagaattaaatactgcaaaattattggtaaaatgtttggaagaagaaggtgttgaatatatttttggtatacctggtgaggaaaatcttgaggttatgaatgccttacgcgattcatcaataaaatttattactacaaggcatgaacaaggtgcagcatttatggctgatgtatatggaaggcttacaggaaaggctggagtatgtttatctactcttggacctggcgctaccaatcttgttacaggcgttgctgatgcacatagtgatggagctcctttaattgcaataactggacaagtaggtacagaaagaatgcatcttacatcacatcagtttttagatttatgtaaaatgtttgaacctattacaaaaagaacgaaaatgatagttcgtcctgatactgtaaatgagattgtaaggatagcatttaaatatgctgaaagcgaaaaacctggtgcatgtcatattgaccttcctgtaaatatagcaaagatgtctataaatagcagtgaaaagcctttaaagaaaaaaatcatttcaaaagaatttgcgcctatagataaaattgaagatgctgcagcagaaatatttaaagcaaaaaaaccggttattttagttggaagtagtgccgtacgtgcagattcaagtcaatcattaactaaatttgcaacagatttaaagattcccgttgtaatgactatgatgtcaaaaggaatagtgccttgtgataataaatattcaattggtaccataggaataccacaaaaagatcatattaataaaattgtggatagtgcagatcttattattgctgtaggatatgatattgttgaatattctccagtaaaatggaataatgatgggcatttaaatatagttcatattgatacaagacctgctcacattaataagttatatcagccaattgtagaggtagttggagatatatcagattcacttcataatattcttagaagaacttcaagaaagcatgaaccttcttatgctttacaaataaaaaaagagattgaacaagaattcaaaaaatttgaacatgataattcatttcctatgaaaccacagaaaattttaagcgatgtgagaaaggttatgggaaagatgatattgtaatatctgatgtaggtgcacataaaatgtggattgcacgtcagtatgaatgttataaaccaaatacttgtataatatcaaatggatttgccactatggggataggagttcctggtgctgttgctgctaaacttatatatccagaaaaaaaagtcctaaccataactggtgatggtggctttatgatgaattcacaagagattgaaacagctatacgtattggtacaccatttgtaactcttatttttaatgatagcaattatgggcttattaaatggaaacagttagatcaatatggacaagaatgttttgttaatttttcaaatccggattttgtaaaacttgctgaaggtatgcatgccaaaggatatagaatagaaaaagcagaggatcttattcctacattagaagatgcatttaaacaaaatgtaccttcaataattgattgtagagtagattatgaagagaatataaaactaagtaagtatttaaaagaactttattcaaaaaaagatcataattaatgtgaaataaagcctagataaataatgtattagttgtatacatcatgttaaacttattgatgacataagaaaaaagtagagttataatagatgtaaaagtattaaaataagtactttttaatgtaacttgaaggagaaaacttacacatgttaaagaaaactgaagaatttttaagaaataattataatataagcgaaaatacttttgaagtatatagacaggctattgatgatattgaagagcaatttaaagattatgacgaaataagagaatataaccaacttaaagtgttgaaagcattccaagaagaaaaaataagtgattctcactttactaatactactgggtatggattagatgatatggggagagatgcattagatagagtatatgcaagaatatttaatactgaagcaggtcttgttagaccacacatagtaagtggaactcatgcaataggatgtgcaattgctggtaatacaagacctaatgataaaatattatgcgtttctggtatgccatacgacactttgcttggagtattaggtttatctaagaaaaaaaatcctggttctttagatgaatatggaataacaactgatgttatcgatcttgataaagaaggtaattttagatttgatgctataaaagaggctttaaaaaacgacaagagcataaaacttatacatattcaaagaagtactggatatgcttcaagaaaatcatttttagtatctcagattgcagaagttatttcatgtataagagaaataagaaacgatgtaataatatttgtagataactgctatggagaatttgttgaaactgtagaacctacagattttggtgctgatataatggctggatctcttatgaaaaatattggtggtggaatagcaccaggtggcggatatatagttggtaaaaaagattatgtagatgcagcagccaatagaatgactgttccaggtgtaggaggagagtatggtgctacatatggacttatgagaagtttattccagggattattctcagctcctcatgttactatggaagcggttaaaactgctatatttactgcaagagtaatggagatatcaggatttaaagttttcccatcatcacatgaaaagagaacagatattattcaagcaatagaatttggtgatcctaaaaagcttgtgaatttctgtagtggaattcaagcaggttcgccaatagatgcatttgctgtatgtgaaccttgggctatgccgggatatgatagtgaaattgtaatggcagcaggagcgtttatatctgggtctacaattgaattatcggcagatggtcctgtaagagaaccttacatagcatatatgcaaggtggattaaactttgatcacggtaaaatcggtgttcttataggtcttgataaagcgctaaaaagctagaaaaagaaaatttgttgactctaaataaagttaaaatataaattcatatattttaactttataaaaagacatacctatataatcataagaatacataggtatgtctttttattatttctaatatgctctgaatattcctacaagttttccaagtattgaacaatcatcaacgattattggatccattgtatcattttcaggttgaagtctaatatgattttcttctttgaaaaatctttttattgtagcgctatcatcaattaatgcaactacaatctcaccattaactgcatcattacatctttctataatggctaaatctttatcatttattccagctttaatcatactttgaccagaaactcgaagcataaataattccttatcatgttttataaaatcaaggggtaatgaaaaagtatcttctacattttcagtagccagtattggaagacctgctgttattttacctactattggaatagaaatcatttctttcttaggagtagataattcggctatttctaaagctcttggctttgaaggatctcttcttataagtccttttttttctaatctttttaaatgaccatgaactgttgaagtagattttaatgaaacagcctcacatatttctcttactgaaggtggataacccttattttctgtgtagttttttaaaaactcgtatatctctgattgtttatcttttccgtcgcccattgcatacacctcgctattcttgtattaattataccatattgtcatatatatagcaaacctatgttctgtagctaataaaatcgtaattttgaaataaggaaccaattaaattagtttataatttgatttttactattgcttttgttataattttaagatgactttatttggagaggaagtgctgtgtgatgggatataaatatacagatgatgattactgtgacatctatgagaataaaatttgtgacaactgcggtaaatgtcttgaaatggaaggtatcgatacaaaagcaataaaaattgaagatatatctaaaaacctagaagaaaattcagttcttgaagaagaatttataaatgatttaaagtcaaatcttacagatgatgaattacatgaaataaatgaagaaaatttagatttaaaggatatatataatagatttggatttaacagttcttttgatgaaaattccgaatcagaagagtacgaagatgctttcgagcatattgaatacatagaagaactttcacaattaaacgatgctgattttgaagatatgacagaagaggtttatccaggagttagacgttttaaaaatacagataaataggttaaaaagcgagtagatttagtgtatacttttttactcgctttttatttattacattttaatttttacatagcaacaagttttgaatagttttatattaatttcacataataataatgtgataattaatgtgaaagggatgagtttaatgaaatataaaactattttagcgttatctttaactgcgatgcttactgtaggagtaatgataactggatgtggcaacaaaactgataactctactaatacaactgacaatgggaatactgctactgataagcttaaagaaagcgcagacaaagcaggagatgctgtaaaagatggagctgaagctgtaaaagacagtgttgaaggtgttggaaatgcaataaagtatacagccatagatgtaaaaaatgatatatctaaagcaggacgtgatttaaaggaatctgtagatagcaaaaaagactattttgctggtacaactgaaacagattacacatcagaaaacggagaacttataagagtatatgaattcaaaaattcagctgatgctgatgctgctgtaaagaaaatatcttcagacggtttaactattgatggtaatgcagtttatacaacaaaaccacattactatagaaaaggagatactatagttatttacgaaggtacaaacgatgcgtacataacagaatttaacactctctatggtaatcctttaatataggagttaaaaagatgaatttgcttattatagcttgttcatcttttttagtgtagggaagatgttataattttgatagcggatttgatttaacagcatctcttaaatcatcatcatcaacatgtgtatatatctgtgttgttgaaatgttttcgtgacctaaaatactttgaagacttcttatatcaacatttccgtatttatacatcaatgttgcagcagtatgtcttaatttgtgaggagtatatttttcgcctgtaaacccagcgttggtaatatgtttttttatcattatttcaactgttcttttatttatgggtgcatttctagcagataagaacaaatatttcttattttcataagaagcttttgaatcatctcttacactcaagtaattgttaagcgctctcaaacaggcttcatttaaatacacagtacgttccttgtcgcctttaccaacaatagataatatatcaccacgtattttttctatctgaataccacaaagttctgaaagacgcattccgcagttcaaaaagaaggttagtatgcaataatcacgtgcgtaattcttatcatctttatccaatgattctaacaaagcaatactttgatttagtgtaagataaacaggatgacgtttgtttattttaggagattctaattccatagcagggttatccgatattatttttgcttttccaaataagtatttaaaaaatgatttcaaagttgctaccttacgagctctagcataagagctattatttctgtatttttccacaaatgataaaaaagcatatagatcccttaatttgatagatttaagaaattcattatcgatattgcttatatttatatcttcaaattcaatatcatttttaaccaatccacgataaacacataaaaatctaaaaaataaagtaagatctatcttataagcatcaatcgtgtttggagatttacttcgtattgtttctaggtaatttaaaaaatcagaaacactttctggaagatcatcatttttaagtacttgaatgtcatatttcataataatcaccttaatcatttctttatatttttactaaatgtacaaaatctcgtttataataagataaaaataaggaaaacggcttgtacactaagtttaagtatattatatcaaaattacgatttttcttcaataatttcgctaaatgtatatttagcgaaattattaatgcataaataaatttaattattatatcaataatttgttttttatcttcaagctacctttgtatttaaaaaatataaaatcactattctgaatttatcgctacttattaagattaatcaaaaataaaattctagaaatatcattattttaatatattcaaaccggtgataaattaactttgaatcaggttggtttattaaatgttgttgcatatataattgaattttactaaaatctaattttttacatgttgattttaagcgaaataaaaatttaaaaatatgttcaaacaaaaataactacaagttgttattttttaaatttaattttataagctttaaaataactatatttactagttttatatactatatttaaaaaaataatattatacaaataattatttatttatataattataatattaacttaatatattatagttttaattactagtattcatatttttaaataccatttaatttgaagctttgtgcaaaaactgtttttttaaaaaaacagcactaccctttcaaatcctcaagaaaaaacagagggagagaaaaagagaagcacaaaacacactattaaagttttttatttttaacccaaaaatgaatatgatataataactatagatagagaaaataagtgataataataatcacttgattggaggaaaaagataatggcaaaagtaaaagaaaataaaactaatgcaatgagattattagatagaaataaggttgaatacactactcattcttatgaaaatgaagatggaaaaatagatggtattgctgttgcacacaaaataggaaaagatgaagattgtgtttttaagactcttgttacagttggacattcaaaagataatttcgtttttgttattccagttgcacaggaacttgatatgaaaaaagctgctaaagctgctggagaaaagaatatagaaatgatacacgtaaaggacattaataagataaccggatacattcgtggaggatgctctccccttggcatgaaaaaggtatttaaaacattcatacataatactgctttagattgtgaaactatagtttttagcggtggtaaaataggatctcagatagaaatgaatcctaattcccttcaaaaagttattgactgtgagtttgtagatataataaagtaattttttatttcattattaaaagattagataatataagttttttaaagttatattatctaatcttttattttataataaatttatattttctaaggaaatccaactccaaagcaagttcctagagaaacacatacgctattactataatttttgaaattagcagccattgctgttccatcatgaacaagttttatttgaaatcgtatattcaaatcttttaagatgcaatctgataaaaatgtctcgtaattatcatttaataatctaagcttgccatatccaccacgattttcaacaacaccattattaatataatttgctatacttataataatttcatttcctaccctaattttgttgttataataactcaaactatcttttataactttcagtatgtgtccatgcagctttaatgcctcttctttttcctcttcaagagtttcatattcccactctacatactttgaaagtactttttctaaattttcaacattaagttcacaatcatttttaaaacttatatagcttctctttataaatgttgcaccacaatccataattaggtattctttagttttatctttattattaatatatgatgaagatccccttatagctatttcatcgcatttttcatttaaaattatattatattgttttacatttgcaagtttaaatactttttctatatgctctttaaattgttcgccaatttttccacttgatagtccacctactaaaattacattttggatattcctccaataaatccaattatctttagtccaatcttttctcttagtaatattttcagaaacacccatttttagagttaataaaattatagcgagcctttcgccaaaaattttagtaatactttcagcacattttctgatatgttcatcattactataaagagatttttctagatattgtggtaatttcttttcttgtatattactcaaatttaaatttaattgaagtgctttttcttttatttcatttataataagttgtgttgaaaatatgtctcccgcatattttccctcaagattttcatttattatatgaggtggaatatatgcgatataaagcttatttattgatacattcggaataagagagccattgattaaaaatggattattcatatttaataaccatccttacgttctaagattattataattatattatatttagaataaatataataccaaaagaaaccgaagtttttactccggtttcttttggtatagtttcttcactactctaaacttataaattacattattcttctatttctccaactaaagagaacgaattagcttttacaatttttacattaactaattttccaattaattctttgcatccagggaagtttacaagttttgcatttctagttcttccgttaatctagattcatcatttttacttgttccttctactaatacctcaacaaccttaccttccatagctttgttacccacaactattccttcattaacagcctctactaatctgttaaatctttcgtgtttaacatcatcaggaatttgattttccatcttatctgctggtgtgtggtttcttctagaatatataaaagtaaatgcagcatcatactttacttcacgtactaaatctaatgtagcctgaaaatcttcttcagtttcaccagggaatcctactattaaatctgttgaaaaagttacatctggaatttcttttcttattgcttttgctaagtttaagtaataatctcttgtataatgtctattcattactttaagtatttgatcacttccactttgtactggtaaatgtatttgttcacataatttatcacaatctcttatagcttctataacatccatatttagatctttaggatgagatgtcataaatcttactctttctaatccttcgatttcattaattcttcttaataactgagcaaatgttatttcctcttctaatcctttaccatatgaattaacattttgaccaagtaaagttatttctttataaccttctgctactaatcctttgatttcattttctatatcttgtggctttctgcttctttctcgtcctcttacataaggaactacgcagtatgtacagaaattattgcatccatacattactgtaacaaatgcttttacactactctttctgtctattggaactccttctacaatttcagcttctttatcaaatatttcttttatctgtactccttcagttttaactctgtttaagtactctgggaatttatatgaattgtgagttccaaaaattatatctacatatggatattcatttaaaattttatcagccatacctttttgttgcatcatgcatccacaaatagctattattaaatctggattattttcttttctcttttttaatcttcctagattaccaaacactttgttttctgcattttctcttacacaacatgtattaaatataataatcgaagcttcttctttatcttctgtaggggtatatccctgtctcttaagcataccagataatttttctgaatcttcttcattcatctgacatccgaatgtttgaataaagaaaaactttgctttatcttgtgaaattttattttgatctaattcttctatattaaagtccattttatttctcctttttatatacaattttcttttgtattataacaaataattagttttattaaaagaccttagtcttttaactatctcgagtaagtacaattcaattttattaaagttaaagatctatagaaatcacaagaaatctttttttctaaattaaagtaaatgtttagtattatataattaacactcgggaattttcgatactaatttaaaaaaagtttactatttctaaacattaatacacttactagatatttttatgaatttctttttcacaaatcatctaaaatccctattttacatattagaattttagatttattctatttatccctagatctctatatttatagttattggcgtatctagatttttttaaatttaatgatcacaatataaaaattaaagcttaattatagtagatttattataattaagctttatacagtatttctaatagaaataaactaattcttcatctggctttttagttgatgatattttttcaacgtgtagaacaggaagttcatcatcatattgagcaatctttgttttatgaactgtagcaattatatctacccattctttattttcaagttcaacatcattttcaaacttacatattagcccaagaggcgtaatgtcatcagcacaacatgtcattgcattacgacctaaaattgaaaattttggtggatatttatctggatcataagccatcactttaagttttagttttttaccatcatactttttagggtttgacatcatatcttcatatagtattccaaaatcatactcctctggttcaatcacatttgcattaatatcaaaaggaagtacatcttcagaattatcaatttctccattttcattttcaaataaaattcttgcctgtatgttaatagctttcacgctacctcttaatgaaatttttttagtatctttattacatctgttaaatacaactaaatcagcatccctgaattgttctaccattatagatcccatgttgctcatataagaactaaatgttgatgcatctatagtacatacaacttgagcaatttcgcatccttttggcagaactgaatcatataaattatcaaaatcccacattccattaaattcaataagtaccctatctgccttacatttttctatttgtattcttattaattcaggtgtaagttcatcttcagaatttataagaataactgttgtattagctttttctaattcatatttttctaattcttctactccttcttcacaaagaataagaagactattttcatttgttacaaaatcttcatcttttaaaatctcttttataaatgttgttttaccactttctaaaaatccagtaaataaatacactggaaccttcattttattcgcctcttttctattaaggttgctacaataattaatactattttaaacaaaataatgtttctatcttatttttatctaatttagatccaatcacacatagtcttcctgtataatctggttcacctttccttatttcaaattcaccaggcacaagatcaaagttataccagtttcctttttcatctgaaataataccttttgcacgaagtataacaccataatcagaactatcacttaatagtgaaagaatatcattaagtttatctttattatatttcttaggggtttcaattccccagcttgtaaatacttcatctgcatcatgatggtgatgatcatgcccacagctacaatgctcatcatgttcatgatgatgcccaccacatgtgcattcttcagtatgttcatgattatgatgacatgaacaattttcctcatgtatatgttcttcaccttcatgagatccatgacagcatttttcaccatgttcgtgatgatgatgttcttctttgaacaattcattttctagtgagtttgatttttccattgcatcgacaatctgcttaccatttatctcttcccatgaagttgtaataacagtagcttttgtattatgttctcttattaatgaaacaacatcttcaagtttttcttgtgataatttctgagtacggctcagtataattgtatttgcattttcaatctgattattaaagaactctccaaaatttttcatatacattttacatttttgtgcatcaacaacagcacaaaagctattaagttttacatttgtatcatctttaatttcttcaactgctttaataacatctgataatttaccgactccagatggttcgattattattctatctggcttatattggtctaatgcttctctaagagcacttccaaaatctcctacaagagaacaacatatacacccagaattcatttcagtaatctcaattccagtatcctttaaaaagcctccgtctattcctatctgcccaaattcgttttcaattatcataagcttttctttataaagtacatcttcaataatcttttttataagtgttgttttccccgctccaaggaatcctgaaataatatcaatttttgtcattttaataattctcctttattttcctatatttattactatttttcataatacaaacactataatcatagcttaataatgtaaatttaaacattcctatataatgaaaaatagttataatatgaaatatatcttcatcttataactattttaacattttttcaagtttcttgttattttgttttttgaaagccaaatactaatataattaaatcattattaaacttataaattatattaacatcttgaatgcacttatatttaaaactttgtgatagctttctcatgctacacacaatgttctaagtgaacttttttatatagttttaacctaaacataaaataccagtcagcttttatttaagctgtctggtattttatttctcttttaattcatcaatatatttttgaatccaagaatcaaccgatctatttttttcatattcaggatcattaatcatatcaacaaaacgtgtagtaacaccatgagtttttgcaataagcataacatttttctgcttatcaacaggtaaatctctaatagcatcttttacatcatctatacgtgccctcttcatatgttaaacctcactttgcttatattatatacatttataccaagtatcatatgaaatatactctctaaacccaactttgttatataacgaaacagctttataattattcttctcaactcttatatatacatgctcaatttgatttattctacataattcaataagataatttaaaagtagttgtccatatccacaacatctatatttttttattataccaaaattaacaatagtatataagtcattgcttaaaattatttgcccatatcctgcacattcattattgacgtataaaaaaacagaaaaatcattgatataataatcctgttcttcttcatcaaaaatatcttctgtatctaaaggaactctattttcatcataaaatatttcattttgaacatcgcatcttaacttttcatcacaattttttataaagtgcttaaaatttataccatctttaacttcaataggttttttagaagctattaatttcataaggcacgttttactatatatagtaaaaccaagcctattcattaagttgctaatactctcattttcaactatatcaagtttaagtgtattacattttataaaatctaaaactttatcatctagtaattcaataaaatcatcaaaaaagtacattgaataaatattttttaaagtattatctatttttgattcatcataccatatatatcctatatgcttattgttgtatttaaaaatcttgacctgcttccgtagtaaatactttaccacaaaagattcttcatcataaatagtaaaaaaatccctatcacatatataagatctatactttgaattatataattttctgaaattctcaatattaaataatgacaatttttcaatagtaatcatgcttaaactccatttctatacgataagtaaattatagttcttatgttaattatagtcaataatatgcaagtatcttaataaaaaattgccaaggtcaccattctatagactacatattaaaaagtcaactccattaaaattaattctttagccaatgtattataatttaagtaagaataaaaaataccgaatctataacacaaactatagatccggtactaagttaatataatcttaatattaaatatcttttatacttaagcttattctcttgttttcttcatcaacacttaaaattttagcctttatctcctgtccaatagttaaaacttgtgcagggtcttcaattctttcgtgagatatcttagaaatatgaaccaatccatcaacacctggttctaattcaacaaaagcaccaaacttgcttaatcttactaccttaccaagtactatagagtcttcaggatatttttcttttacattatcccaaggctttgccataagttctttcatacttaaagataatttttttgtttctttatctaaacctatgatttttacatctacaatttgacctatctttaaaacatcttcgattttcttaacatgattccatgaaatttgagataaatgtaataatccatctactccatttatttcaacaaaagcaccaaaatcagtaaatctttttacttcaccttttacaacatcatttaaattgaaagattcccatgcttttgtttccatttcattttttgctttttctaataaagctcttcttgatgctacaactttaattggctttgcagtactaaaatcaataagtttaacttctaaagtttgatttaagtattgttctttatcctcagtaaatttaacatctatctgagaagctggaacgaatactcttattcctttataatttcctgctaaacctttatcttttgcttcatttatttttatttcaaaagtttttccttcattgaaaagaacttctaattctttaaaagcctcttctttttcatattctaatcttgataagactacaaatccatcattattttgtaatttaataacttttgcagttattggatcacctacattaatgctttgtgcaaattcttttggatcacattttcctgttaattcattgtaaggaataattccatctatcccatatccattcattccaataacaagaccttcattgttctttgaaataacattttcagtaacttctgttccaattacaactttcatatcagtctcattcattaatgctaattgatcttcattatttacattgttttctatactcataatatcaagtacctccctaataatccaatctggtgttgatgcaccagctgttactcctatttttttatatcattattaataaaatctttaggcaaatcttttatattttcaatgtggattgtatgttcacagttttctttagctatatgatacagtttagtagtattagaactattctttccaccaataactatcattgcatctacttgttttgaaagatcataagtacttttttgtcttacgtctgtagctgcacaaattgtattgaaggatagtaattcctttgcatcttttaaatgctccacagtattatcccagtttttcttcttttcagtcgtctgagcaacagcgcataccttttctggtaattcaatatctatattaccatctttagttatggttgcatcattattgcaccaaccattaatacctactacttctggatgtttttcatctcctaatattactatatgatatccttcttccgaatatttctttaccttttttgaatatttgttacaaagggacatgtagcatttacaactgttagacctcttgattccaacattgctaatacatcttttgaaactccatgagatcttataacaattacatcttttggatccaaattagatatatcttcaagctctattgaaaatacattattatcttctaaataacttacaacatcattattatgtattaagggacctaaagtatatatttttttattatactgtttttgaatattaatagcttcatcaacagctcttttaactccaaaacaaaaacctgaattgttcgctaaaataacttccctcattaccatactccttttcataagtaaacccagcatttagcactttatctaatctatatgccagcatatattactctattaatctcatctacaacaccattaatatctagtgaagtactatctatttcaatagcatcatctgcttttcttaatggatcagtagctctatgactatccttataatctctttccacaatatcatttaatatttctttataagaacactcaatatttctttcttgaagttccttaaatcgtctatttgctctttcttctgcactagctgttaaaaagaatttaaaatctgcattttttaatacgacagttccaatatctcttccatccataataacactgtacttttctgacatatctctttgaagtttcactagaatttttcttacttctggaatacttgcatatgctgatacaatattactaatttgtggcatagttattttttcctgtatattctcaccatttactattaaatcatcgttttcaaaatgcatctctaacatttctgttaaggcacaaatttctttaacatcttctggtgatatattattttctttagctttcagtgctactgctctgtacattgctcctgtatttatgtacataagattgtgttccttaccaacaagcttagctatagtacttttgcctgcacctgctggtccatcgattgctacacttattttcaaagttattctcctcatttcttagaaccataatttaacgcttacaataagattatataattttttgtcgtggcaaacaagaataagtttttatatgacaaattaatacaacctagattgtgatattatttcctgctataaatccagttgcaaaagcaatctgaacattataccctcctgtaaatgcatctacatccatcacttcaccacagaaagataaattatctataatttttgatttcattgttgatggatcaatttcttttacatcaactccacccctagtaactatcccttcagctaatgggcgaagtccatcaatatcaaaagtaaaatctttcaaagtatttactaaattttttctttcttctttggtaatttcattaaccatcttttcctcatttatattagacatattgattatcataggaataatcttttgaggaagcaaatcatttaaagaatccttaaatttattatttatgtattttgaaaaatccttttgtattcttttatctagctctccaatgctcagagcaggttttaaatcaacatgtgcagtatatgattttcctttttcaataaacctacttccttttaatataagaggtcctgaaactccaaatacagtaaaattaatttctccaaattccttatagacactttttttattgttttctttaatatttatttctatgtttcgtaatgaaagtccttgcaactccttagtttttccatctttcaccaccataggtacaagtgctggttctaattttattatattgtgtccaagttttctggcaaattcctgaccttctcctcttgaaccagtaagtggatatgatcctccaccagtggccataataaagtaatcagctttcattacttcagaattatttataactattgatgttatttttttatccttaaatttaatgtctgttacttttgaatttagtttaatttttacattagtttctttaagtgcattagataaaccttttaggatatcagaagacttatcagagtctggaaaaactctatctcctctttctacttttagctttataccatggtttttaaagaaattcatagtatcttcattagtaaatgtatataatgcactgtatagaaaatgcggattaccaggtatataatcaaaaaattctgaaatatctttagcatttgtaacattacatctgccttttccagtaataaaaagtttcttgcctattttttcatttccatcaatcattgttacatcatgatacttgctcgcttcaattgcagccataatacctgctggtcctgctcctatcacaattaccttactcaattttaaaaatcagctccttaatctatcatttatcttatctattatacttcataaaaatatatataacaatttaaaatagcattagtaacttttattaaagctatcaatgctatttttatatatagacataatttaattaattataacttttgtatcttttggtacattgtcatatatatatttagcattggtttttaaaagtcttatgcaaccattagataatttcattccaagtcttccatcccttactgttccatctagattatatattattgaatgaaataggtaatttcccttaaaactagaatagtaccagcatttatatcctttctcaactccaaagtaaagccccttgacaccaattttaaaaacaccagatggtgtaggtgtagaattctttccaattgtacaaaggtaacttttatctaatttccaattattttttgttcccttaaatatgttaactttaaaattacttaaatcaacgtaaattagaaattgtgttatactactgtagttattactattaacaaaatcggtaatgttcccatcataatctttatcatttctcaatttaaatttcaaagtatagttttcaggttcatttttaaaatctaagtgcaataatttacttataatactcatacatctatccataaatattgataccttctattactatatggaatttctttatttttgtataaaacttttttctttaatactaaatttaactttttatattttcaattctatatccaatttctttatttgcttttctataagattcatttatcatttctttttcgttcatttcttctcctattaaagaatcaatagtcagctgtgctctttctggaaaatatttatctaaaattcgttcttcaatttctctttgtgaacaggtactatagtcatctaatatatgacgtacgttaaattcagcttttgtcaatgctctcccacataaaatacttctatggcatcttattggatcttgcatagctcctaaaagtgctatattatatcccttactacaccctttttttaatctttcaataccgctaataaattctttttcattaataactttttcaaaatcagcataaccttctttattatatgagtttttccttgtacgctttgcagcaagttctctcgccatataaatatatataaatccttcagattttaaagttttttcaataacttctttattatactgtatattatatttagagtatggagttcctcttatatcaactactgtatcaatattgtagtgtttgagcatatgtatcagtttctcttctggataattagaatggcctatagtatagattgtcatatttactcctccaatacacaaataataaatgttccaattatattttcattatggttttgtatttttattatatcaatataaactgtaaaatatatattttagagataagtttttaaaatattcataggtagtttcttttatactaaaaattactagcaaagaacaaaataagaagcatacaagataaattaatcatgaatataaaaaaacctggaaaatacaaatattattccaagcttttattgattcatattttatgttcatttaattaaaattacagtattcttactacattttcaacagtcttctctaagttatcagctccatttttcaatgcttcatttaaagattcaacgcctctcattatgctaaataaagcaattattccttcatcaaataaattttctgcatcttgtgataccttcccaccaaatgcaatcgtaggaacattatatttttttgctattctcgatacccctacaggagttttaccaaaaatagtctgaccgtctattgatccctcaccggtaaatacgtaatcagcatccttaactttatcttcaagattagtgtattttataacaagttctatgccactttttaattctgcatttaaaaatgcaagaagtgctccaccaagcccgccagctgcacctgcacctttaacatatttaatatcaatatttaaaatttcttttatcttatccgcaaaatgctcaaggtttttatctagtaattctaccatttctgtatctgcacctttttgtggaccaaaaatatatgaagctccggtaggacctataaatggattagtgacatcacatgcaacttcaattgtgacatcttttatgttgctatgtaagctagataagtcaattgtttctattttatttaagcatcctcctccaaatgaaatttcattgttattttcatctaaaagttttacacctaaagcttgaagcataccgcagccaccatcattagtagcactcccacctattcctattacaatatgttttattccattttctattgcatgcttaataagctgtccagttccatatgtagttgttattaatggatttctatcttctctttttataatttcaattccacttgcttttgccatttcaattacagctgtttctttgttacctaaaattccatatgaagctttaattttttctccaagtggatttaaaacttcagtttcaacaaaaaacccacctgttgaatttactaaagcttctacagttccttctccaccatctgccattggtacttttaccacttctgcatcatttttaattttctttattgctttttccataacatcacatgcttgtgtagatgttatgctttctttaaaagaatcagttgctaatacaaatttcattatcatacactccattattttatttttaaacaatatacttaccaatgaaataaatattcaatgataagtatattaataaataatattttaaattataaacccaaatattattgttgatattattgtcatagtcaatccaactatagcttcaaaaggtataagttttaacctttcattcatattcatattaatacttccgcctgtagaatggaagaagcttccgtgtggtagctgatctattactgtacatccagcatgaatcattgctgctgttgctagactagatactccaagactagttattgtacttccaaaaactgaacttgcaacagcggctccagatgttgtggaagccgttgctcccgccattaatatacctgaaataggagctagcgcaaaacttggaagacctaatgtatttattccagaaattataacgtcttttaatgctgaatttgaaattattcctgcaagagtacctgtacctattaataatatggctactccagtcattttgcttaatccaaaagaagcatattcatttaattttttaagttttcccatggcaataacacctataataccaccaactggaagtgcaatcaaaggatcaatgcttatattagcaattggtcttagcattaaaagccctattgaaactaatggtccagtaattgctgataaaaatgatggtgtcatttcattattttcaattacttcggcagcttcaacatatgttccttttttagtaagtctctttgaaataatgcaagttattactacgcctaaaattgctggaattataccagcaatcataacacttgttaatgaaacatttagattttcagaaactgctattgtatttggatttggtgaaattatgttacctgctttacctccaccaatcattgctaaaagtattgcactttttgttatatttgattttcttgcaatctcaagtgatattggtgctacagttataactgcaacatctacaaatactcctactgctgtaagtaccattgttgaaattgttaatgcaataagtgctctgttttgacctagctttgaaataattgtttcagctatcttagttgctgctcctgactgaataagaacaccagctaaaacacctgctgttagtattcttaaaattgctgtcatcattccctttgcaccattcatcattagagttactgtatctgtaagatttgcacctcctataagtcctccaattagtgctcctattattaatgcatacgctggctgtatcttctttataataagaaaaatagaaattgctaaagccaatacagcacctaatgcacttacctgtatatccatataattccctcctgatatttgtttattaaaataacacaattgattgtatatgtttacaggtgttatgtcatcgtttaagcaatcaaaaataacaatatttttttgtgcatttgaacaattttaaacatttttcattctaatgcaaagaaaaaatagtattaattggtataaatccatgtaatcatttaactttaaccctgtaatttcctcaatattattaagcctataattcaatgtatttctatgtatatgaagaatttctgaaaccttatttttttctccattaaattcaataaatttcaataaagtttctagtaactctttacctccattttgctcatataatttatttttcatcttttcgatttcagaataatttaaattcattatagagttattaattagtcttatactatcaaaaaacaatatctttttacttttataaacagcacttattatatttaaggtatccatagcttctataaatgatttattgagattctcatttgatgaactaacagcaatttttacgctatacttctccatgttatcacttataagttctattctatttttaaaatttttattatcttttaaaatcaaaattaatttctcatcagataatttaatatagtagtcatcttcatatatatacctttttacttctcttaaaatagtgctagatttaatgtttttatgtaatataagagccactctttttggttttaaaatatcaatattaatagactgcccctttaaaataaattcattgttatatttttcttttaaatatatccattcataaagaaattcttcctttagcatttctttttttaatgctgatttcaatgaatattgttctgaaagaagaagttcagatgtaacctttattatctttccaaaagctgaaatatcttctggatttcctgttattcctataaccccttctatttcatctttaaagaatataggaatattcaatccaggttttacaaattcatcttcattataaatctcaacttcctttttttctgtaagtgcctctgctgcaccataatgaatagttccaattctatttttattactactacctattataataccttccttatccattatattgatattatatggaagtaccgttgatattttatctactattttctgtgctatttgtttatttaacattaaattcttccttctatctttatatactaagttttaacaataactataaaataaatacccaataatacaaaaatttattattgggtatttattttatatatagattctaatttattcttttatacaacctggaatatgaaaaatttcaagtagtatgattcatcagaattccaaagaattgggtggtcacaactttgagttctcacttcaatttgtcttaaagttcttcttgcatcatgtgctgcttcacatactgtcttcttaagctgttcttcactcatataatgtgaacatgaacatgttgcaaagtatccaccttttttaaccatttttattcctctaaggtttatctctttatatcctcttatagcttgattaattgtattcttagactttgtaaatgctggtgggtcaagaattacaacatcgaattctcttccatcccttgaccattcccctaaaacattaaaagcattatgacattcaaatttaacaatgtcttgtaaatcattcaattctgaatttcttattgcacagtctacagcatgttgagaaacatcaattcctaaaactgattttgctccagctatcccagcatttagtgcaaatgagcctgtatgagtaaagcagtcaagtacatctttacctttgcatattctatgtattgcagctctgttttctttttgatctaaaaagaaacctgtcttttgtccattttctatgtctactatgtatctaacaccattttctattatttcaacattagtatcaaaaggctctgtaaggaatccttttatctgttcaagaccttctatttccctcgtcttaatatcgcttctttcatatacacccttagcattgtattcttctacaagtatttttactattagatctttgtatttctccattcctaaagttgaaatctgtataacataataatcactaaatttatctattgttagtccaggaaggaaatctgcttcaccaaaaataaatctacatgaagaggtatctataagagtttttctatattcccatgcatcattaaatcttttcttgaaaaattcttcatctatttcttcatttatgttacgagtcattattcttattgatattttgctcgcatcatttatataacctcttcctataaagtaccccttatgattatatacttctacaatatctccgttttcatattctccatcgtattcatttatttcatgtctatagacccaaggtcttccttgttcgatttttttgttttttccttcgtataaataaaatttgctaaacatattttatctccttccttattgtatgctttatagattataacacattaatctagtattttaatatacaatactattaatttgttaattaacaaagctctactattaataatagagcttttaattgtggttattattttattataataaaaattattattttagtatttctaacattcctatttttttcaattcaattattatattatcatacataatatctatatcttcaaaaagttttgaaaaaatattatcataatctggattttggcagtggtataacatattaacaaatgatgctttattagtctttagtacttcacaaccttggaatggatttgctgttcctacatataaatcatttttatcaaccataagaattcttccaccatagttattaggatttccaagaccagataaatttaatggtttaaagtgtatcccatcaattgatgcaaaaagatcaaatccttttggataatcaaacatatcaaataaatatagtattttatcgtataattgtaatattaactcatataaaatcaaaccaactttttcaactattaggtctttattaagaagcactacatcacgtaaagtttccatattggttccatgatcaaaagttgcagcaagcagacatccgcaatattcttgtagctgccatacatatacattaaaaggattagaaaatcctgataaatatccagataaacttctatttcttgtaccagttgttggatctgatggtataattgcatttcctccaacaacaatttcccaattatcatttttatctattctaacaatatctgcacccattggaattaagaacacaagtggtatttgctttgtagctgttatataaagataatcaccatatactttaattgccattgcatttctatttaatgaatctccaaatcctttgtctgcaacaagtgtccaatcatttaatttaggaactgaggaatttgatctccaaacttgcattccatcatccttacttatacatacatataatctgttattaaatatagccatattatcgattccacccattggattttgctctgggattaaatcagggtcatttggatcaaatacaaatttaaaatcaaaaaattctggatcttcactatagtatagtaaaggaacatttccacctatggctgttgaatcatcaatatctgcaacatataagagaccattaaatgataacattgcccttgacgaaccacctttaagaacaccagtaacattggtccagttacttccatctgttgtctttaaaatagttatggtacctcttaaagaaaaagaggcagcatataaagcttttgatgaattttcagctgcatgaattaacataaatctaaatccattaatatcttctgaattatctgctttataaacacgttcccatggtaaagactcatcttttttatatctccatatttcaccattgttgtttttctcagttgttcttattaaaagaggggacttagcattctctcctaataacgaaactgtattccaaggtatatttcttgctgttccaacataaatatatccattaaattcagccatacaccatgaatagttgttttgtttagcattttttaaatctttgaagtcgaatccatttattttatttaactttttaaaaatagacatcaaaacactccttatcataagttatataatataatatatgataaggagtataaaaatgatattatttaattactcaaatgacttttttaaagcctttagcagaacttttgcatctttattatatgatgttacaggacatatttctttattggttacattaaataatgtataaatagcaattcttgctgcacgtactgaatattcttctgtaaataccatatcatcagatatctctacgaactgacttatcattgcaaaattagttgacccttttggaactacgtcaggtctatcactcatcttccttggctggaattgtgaatctatataaggcatcatacatggaataacattaattatatcctttaatatctcttcctttttatctattaaatgaagatgatataaaagttctataagtatctcttctcctgtacactccatcattggtttatttatataatcaccgtttttatccgtatatagtccatatccccaaaatattgtagtatccataggttgatttttaaaatgtggttgtgctgctactactatactcataagccagcttgaatctttaaatgtcataagcgctccacttcctggaacattcatagagaattgttctatatacttaaggagcttatttcctttacatgtaacagtaaaactctcccagtttgtcatctttggataatcaaaaaatggttttggacatccaagtcctggttttttcaaacttattttttcccatagttctgatcccattggttttgaatcatcaaatttaggtgcagtataataatctccaagtgttgcattatctgtcatgcatccatttatcataatgcacttatcattatcatttaaataaataattttctcttttgaattagttttctcattattagtgctggatttttcttcaccatctgttatatgaagtgatttcataacttcacttactatagcactatcatgtttttcatcattatcattaggattattatcatcaggatctttttccacattattagatttactatcttcttcatcagaaccatctaaatgtgattggttttcaagattatctatatcagatattacaccatctgtagtatctgttttactgtcataatttattggtgaaccttcttctaaatgtattgcactaactgttataccacgacctgctttaaaatctaaatctgtaacttttgtgttgaccataaaatccacaccaaagccttcaaggtatttttttaatggaagtattacagaatcatattgattgtagggagttcttgtaacaccctctaaagtttctattcttgaaaattcaaaaatcattcgattcatataacgcttaaattcaaataaactagaccatttttgaaaagcaaatgtagtctgccacatataccaaaaattagttgtaaagaaatgatcattaaaccactcttctattgtcatttcatcgagattttcttcattagtcatcattaatttaaataactctaatctatcaatattgttaaatcccattgtacttacatctactatgtctccatatttatcaactaaacgtgcttttgcatgtgttggatgatggtgatcaaagtttaaaatttcttcagtaacacttttatttggatattccaatgatggaatagttgaaaatagttcccaaaagttctcataggtttcttcatttagcattcttccacctctacatataaaccctgtttcaggtgatcctgctccatcattacttccacctaaaatttttaatccttctattatgtgtatattttctcctttgaaattacaatctcttataagatatgcagcaccagctaaagatgcaagaccacctccaataaaatatacattactatctgtatcagaattaaaaactcgtttataagtagtatagtcatcttctttgttcttcttataaatataattagctgtaagtcctgccgcaatacttatagctcctatacttataatcttttttaactgttctttttttagaattttttcatattctttataatctctttttttcatatattcacctactcctaattttctaaattgtaatcatatctcagaaattaaattcttaaaatatattaaaaaatattgcatattatagtatggcaatttttaatacaattaattcattaaaaatatgtgtttaagattacttttattcttaaataaaaataaccgccatcctttcatttttaatggcgattattctaatattaatatttataagaatttcttaacaattctatttctcttgcataaccatcaagttcattaggtgtttctagatagaaaggtatatctttaagtttaggatgattaataatatttgtaattgcagttaaaccaatacttccttcacctatcttttcatgtctgtctttatgactgttaaatggattcttactatcatttaaatgaatagcacataatctatcaagtcctattattttatcaaattcttctaaaacaccatctaggttattcactatatcataacctgcatcatgaacatgacatgtatcaagacatacaccaatatgctcattaaattctaccttacttattatctgtgcaatttcttcaaaacttctgccaatttctgttccctttccagccattgtttcaagaagtaccttcgttgtctgttctttttttaatactttatttaaaagctctgcaataaattctattccaacttctgttccttgtttaacatggcttcctggatgaaaattatatagattattaggtatgtactccattctctttaaatcatctgtcatcatttctaatgcaaattctcttgtactttcgtcttttgaacatgcatttaatgtataaggagcatgtgcaagaattttagaaaaattattttcttccataagcttaattaacttattaacatcactttcatcaatatctttagctttccccctcttggattacgtgtgaaaaattgaaatgtatttgcacctattgataatgcttcttttcccatattataaaatccctttgtagttgataaatgacatcctatgtttaacatatttatatatcctccgtctaatttttatcttaatcttataaacttctactttatatctaaatatcaaaagtaaatctactctagatatacttattgaataataattattacataataatatattagcacaaatcacataaaataaaaacatttagttgatactatttattaatccttttattaataaaacttatacataaagctgacaaattcattgtcagctcatattaatgtattttttagtttttactactccagtattttttgcttcatcttctaattttaaaagtcttgtataataatcaggaaattcaagaaggtgtgcaagtgctatcattccagttaatattggatcattatttgttacatttgccactggaaatcttgttccatgctctaattccacattcatacccatataaaattcttctaaatcaaatttttctttatcaaattttattcctaatttttttgcagtatctgaactttcttctcgtgtgaagaataatttaatattttctcctctatttttaccttttatccatctacaatatttcataataattcctggcaaaattgatatacatcattatatgtctattaaataaaaaatgtacagcctttatgtttaagactgtacatttctattaatattccaaattttcaactacatctgaagcattaaatgtttctttaagaagtcctttactaacaagccaatcaatattattctgccatactttcgtatcctggtagaggaactttgcattctctgtttccataacaggaatcaaaaattccatactcttcttttcaacactttcactaagaggaaaattttctttattttgattatcaagaagtatttttaatgattcatcaggattatttttcatatcttcaaatactttttttgatgctcttaaaaatttagagatcttttcactgtttttatttaatgtattttcaccagtaacaaaaacaagttcataataatctggtacaccgtactcattagggaagaaataatttaattgcattccttcttcctccatttgtggaacctcatgattaacaagacatccaattgttgcatctacttgatttgtagtcattgaactcattaaatcaaatcctacatcaactgtttgtgcactatttggattttcaccaacattttcaagcattgtagaaataataccttctgaaagagcagttcctccatatccaatttttttaccaactaaatccttgggattttttatatttttatctttaagtgataaaataatgctaagcggtgactgaactattgttcctactgcttttacaggaatattttcatttcctctagccattgcaacatcttgaagatagtatactccaaggtcagctttaccagatgcagtcattgaaattgcatcatttgtatttgaaggaaattgaatatttactttaagtccttcttcttcataatatcctttttcaattgctgtataaatgaaactgtgaacagcatttggataccagtcaagaacaacattaacttcctctaatttttttccatctacagattcattattcatagatgtatttttacaccctaaaattccaaatgccattattcctgacattaatattgataaaattttctttttcataattattgattcctttctatatgtaaagtagattggttatttaacacattgtttattaatttataattcttttctccatttcacaaagtgtttctctgcaatagcaactaaatatactaataccatagctactactgataataatacaatcggtgcaaatacacctgctccatcaagttgcgtcatcattctcttgctaaaatatccaagaccactctgtgctccaagccactccgcaatggccgccccaataatactcaaaggaatagccatctttatagatgaaaagaaatatggcagtgcacttggaatttttagttttatgaaaatatcctttttattagcaccatatgtaattaataattcttccatttctctttttgttgatttaaacccatcataaagagttatagttattgggaaaaatgtaatcaatatagttacaagaactttactccatattccataaccaaaccataaaacaaaaagtggtgcaattgcagtagttggaattgtttgtgatgcaattattataggatatagtgcattagctgctttttcattaatatccataaatacagcaagacttattccaagaactatggatattataagtcctaaaattgtaactcccattgttgctggaagatgaacttttaaaagtggctctctaagttcatataatttactcataatttggactggtgatggaagtatataatgtgcatcaattatcattgcaatcccctgccaaataattagaagaattgttgtaagaataattgatggtaaattctttttcatataagcctcctatatatttaatttgtaattaattattattgatagatctaagctgctcaattaaattttcctttaaagatattatttcaggctttgaaagaaccgatctatttcttggataatctaaaggaatatcaacttttttcaaataagttataggtctatcacaaactacaaaaactgatttagataataatattgcttcttcaacatcatgtgttataaacaaaattgttttattcaaattctgccacatatctaatagccattcctgcatagccattcttgtcaatgaatcaagtgcactaaaaggttcatcaagaagaagaatatttcctccagttaaaagtgttcgtgcaaatgaaaccctttgtttcattcctcctgataaatccttaggaaacttatctttatatgattcaagaccaatttcttttagcatattttttatgtttttttctcgctcgctcttatttactttatttatttcaagaggaagagctagattttcaccaatagttctccatggaaaaagtaaatctttttgtggcataaatgcactataatttttaattttctctattgattctccatcaatcaaaatattaccatgctgcattttttcaagactatttataagtctgaatattgtactctttccacatccacttggaccaattatagaaatgaattctccttcattaacttgaaatgataaattcttaatcatttcttcattatcttcattgtatttaaatattacatttttaaattccaacatgatttttctcctaaatttttagtttaataaaatagaattattcaacatatgtttgtccattattataagacatatcccaaaacatatattcatatttactacagtttataaatatagtttttaacgtgtttattcttgtatcactgcattgttcacctaatttatctactaaatctatcaacttattattacattcttcatattcctttgatatatacccatttatccattctccaaaaaattcattttctttagctaaaggattattattaattttatctgcaataactttatagctccaactgcatgatagaacagaaaccaataaatctaatatatctccattttgagatacccataacatataatttgtatatgatgtattagaaagagaaggctttgaatttttgattatatctgaagttatattcaatctttccatgtattttttatgtacactcatttcaaagtttaaagtagagtgaacaagttctgcaaagaatctcataatttcttcatttggagcttttacaattccaagtgcaaatatttttgaataatctaaaagatatatataatcctgtatcatataatatttaaatttttctaaatctaactctccattttcaataccttttacaaatggatgttcattatatgaattccatatgtcttctacactgtcataaagtactttactaagtttcatcttgttacctcttttcatcaaatattaaatttttagacacaaaaagtaactaatttgatttaaggaaaactttttttaagcaacaaaaaaagccatcttataagaaagacggctttttaaatataatcatagttattttcaaaatatacttacaagctcacttccctacgttggaattacccaagacaggttcaaagggttaagtaaattttactctctcagctttttcagcacccctagttatttttggtctatcagtattatacaatatatcctttattatgtaaagaatttaatcttaagtgtgagttatgtttaatatatatactatattttcgcatattattttataagtatactttaataactttatctttttatattatgtttgtaaataattttaaaacctgaaataagcactgctattttaacagcgctttaattcaattaaatacttattcagctattagttcaaattcaactccctcagcacaatcaggacatctaaacactaattcttcaaatcccattacatcttttgagactctctttctcgccgcatatatgaatggataaattgcatttactgctgttaggcatatattacctgatttttctttgtttaataatgcaccttcaatataaatctcatcccccttcttatagaattcacagttagatttccttacaactatttttatcttgctttctttaaattctcccatttctttatctccttaattatgcctaactctccataaagcgttttaagaattctctagttcttggattgctaggattattaaatattatttctggtatatcattttcaacgataactccattttccataaaaattgttcttgttgaaacatcccttgcaaaagccatttcatgagttactattatcattgtcatcccatcttttgcaagctctctcattacttttagtacttctcctaccatttctggatcaagagcacttgttggctcatcaaataaaagcacttcaggttccattgcaagtgctcttgcaattgccacacgttgtttttgtcctcctgagagctgtttaggctttgcatttaaatataatcccataccaactttttctaaatatttcaaagaaatttctttagcatattttttatccttttttaaaacttttataactccaaccatgcagttttcaagtactgtcatattattaaaaagattaaatgattgaaataccattcctactttcgatctatatgttgtaatcttgttttgcttatccataatattgttattattatgataaatttctcctgaagtaggtgtttcaagcatattgatacatcttaaaagtgtagacttgcctgaccccgatgcacctattatacatataacatctttgcagtttgtattaaaatctatatcctttaatacttcatgttctccaaagactttgcttaaatgtgaaactttaattacaggcatgtcatattcattatttattttgcatttgaaagcttccatctttaatttccctccctacttatatattttgcaaatatatatttttattaaatatataaactttctatgtgtaacttctaacataatttatccattttaaattgcaatatattaataaacttataatattaaattcatttatatgctcaatacttacttttaatatatttataagcataatcattaataaatatctaatatttgtgtataaattaaaaatatttattatatatctcctgacataaaatcactttcagaaagtttatagtcagaaggaccatccatttttttctctattaatcgtaaaatacgtgatacaacaaagttcattacaaaataaattacacatattataaaaaacactggaaaatacttgtaataaacccctgctgctgattttccaacaaaatataattcagatacagatattacatttaatacagatgtatcttttatatttatgattaaattatttcctatctgaggcattatatttctaagtgtctgaggtagaattacataaagcattatctgaaaatgagtcattcctattgcttttgcaccttctgtctgacccatatctattgattcaataccaccacgaactgtttcagccatatatgctcctgtatttattgatactacaaataaaccagctgtaaatggagccatatcaatattaaacgcctccatcgccccataatatataaccatagcttgaacaatcataggagttcctctaaaaaattcaacatatccagttaaaataacctgagataattttaatgtatacttataaaatttattacaatcttcctgtacttcaatctttcttacaattccaactaaaaatccaataatacatccaattactgttccaataagtgcaagtataagtgtatatgctgcaccttttataaataattctccatatttttgtattaaaaatactacccatccaaaaaagtcatttggtaaattagatgtcataactactcccccaaatcaaattcaataaattattctgataatggctggcattttattgcttcgtccatcatttttgccctatcctcatcacttatttcagcaagagcagcattaattttttcttttaattctgtattacctttttttattgcaattcccatattcacatcttcatcagaagcattaaatccttttccgtctttaaaatcaagtaaaactaaatccttatttgaatatgctgctgccattgcagtaggtttatcagttgttacaacatcaatcttaccagaatttaaagcaacaatcattgctggaacagtatcaattgcagcctgtttttttgcttctggaatctgatcaagcatatcataccatacagtatttaactgtgaagtacatgctgctccttttaaatcttcaacattcttcgcattttcataggcagttccttttttagttaatgctactatatcagctttataatatacatctgaaaaatctacactttctagtctctcaggggtaatactttgccctgctatagatacatcaatttttccagaacttactccaggacacaatccatcccattccatcttattaatttgaagtttatatcctaatttatctgctattttttttgccatcataacatcataaccatatgcatactcattatttccatcaatttttatggctccattactatcatcagtctgtgtccagttgaaaggggcatatgcacattccatacctactttaagtactttttctccgttatcagaagagcctgtactattacttttgccacatcctcccaatatacttagcatcgatatactcaatactactgatatgatttttcttaatcttttcatactaattcctccattaaaacaaaaagaagccaacttacaaaagttgacttcttcgccatttattatattttatttattaattatacatcaatttattagaatttaccaataaaaattatatgaatatgaaaatattttttcctttatataatttttattatattttatcaaaagcacttgcaagcattagctttattctattattttgattaacttcgctagagcctggatcatactctattgttactatattaagcttattattaagcttcttaagagcttttatggttccacgtgctacagcatgtgatggtagacatccaaaaggctgcatacaaacaacattgttcactccccagttttcaagttccataatttcacctggaagtttccatccttctccagactgatttccaagagaaattattttacttgcattatgagccatttcatctattttttcagtaacataaaaaattctgctctttttaagtgcatcaatatatactttctgatatttttctataagctttattgtaatttctcctttaagtttgcttatatattttccatcaagatgtttatagttaaatatctgattttttgctgatgataagaataatgaaagcaagtcattatgaacaacttcaacaccttctttttcaagcatatttacaatactattattggcaataggattaaacttaactaaaagttcaccaacaagtcctaccttaggtttatatacatcaattcttggaagctcttcaaattcttttattatacttgaaataatacttttaaaattcttctttaaaggttcttcaaatgattctctacatatacgtgtccattttttgtaaagttcatctgcacttcctttgattttttcatatggtcttactctatgaagtactctgcttaaaagatctccatatattactcctactatggattttttaacaagatcaagattcattccttccaatgaatttgttttatcaacacctgcaagactaagagataaaactggaagatcttcatatcctgcttcctttaatgctttttcaagtacacttgtgtaatttgtaaatctacactgtccttcactctgtgcaagaagaatgctagtattttcaagatcatatctaccactctttaatgcttctataacttgcccaataacaactatagcaggataacatatatcattatttacatattttaacccttcatcaattgcattatcaccattattaagaaccactaaatcatatccacaagctctaaatgcagattctagtatattaaaatgtattggtgaaaactgaggtactattatagttttattcttccctggatttatgaattttttagtatccttttttgtaattgatgtctcaatatttttatttcttctttcttctattgcagctttaagtgatcttaaccttattcttgcagcaccaagattgcttccttcatcaatctttatattagtgtatatttttgatccacattctaatatctctgccactgcatctgtagtaatagaatcaagtccacaaccaaatgatgtaagctgaacaagatttatatcatcgtgatcaataataaaatttgatgctctatataatcttgagtgataagcccattgatcaacaacatttaatttaccatcaatttctccaagatgtgctacagaatcttctgtaaatacggcaaaccctaagctgtttataagttttggcattccatgatttatttctggatcaacgtgatatggtcttccaccaagaagtatcccctgaatgttatgatcctttatgtattttaaagtttcaacacctttttctcttatatcctttttgaaattttcttgttcatcccatgccttatcaactgcataatttatctctctttgagaaatattaaatatagaaagtgcatcttttaatcttttcttaagtttgcttttattagctattggtaaaaatggattcataaagtttacattgttttcttctaagctatccatattatttttaattacttcagcataagatgttacaactggacagttaaatgtatcagttgcatttttaaattccctgctttcatgaaggatgcaagggtaaaatatatttttaatacctttttctattaaatcttcaacatgaccatgtgtcatttttgctggataacaggctgtttcagatactatagaagtcagtcccttttcataaagttccttggaagatttttctgatatttccactctgaatccaaggtttgtaaagagtgtaaaccataatggataattttcgtacatattaagcactctaggaataccaataatccctcttttagctttatttaattctaaaggttcataattaaatattctgttatacttgtactcatataaattgggtatgttcctatcttttgtattatttccaagaggtgtatcacatttgtttcctgcaataaatctatttccatttggaaatctgtttattgttaaaagacagctatttgaacatcccctacatcggctgttagttgatttcatttcaatgttatcaacattttcctttgaaactaacgttgatatatgtatattatttgctttaacttcatcattcttattatctgaaatattattttcttcaactgttgcagctgtttcatcatctatataacaagctctagcttcataattttctttagctagtattgcagcaccaaaggctcccataagtcctgctatatttggtcttataacatttctaccagataatctttcaaaacttctaagtacggcttcgttatagaaagttccaccttgaactacaatattatttccaagttcatctggatttctaagctttataaccttataaagactatttttaacaactgaataagcaagtcctgctgctatatcttctacagtaaatccttccttttgtgcctgttttacttttgaattcataaaaacagtacattttgatccaagatcaactggtgattttgcaaaaagtgcctttttagcaaaatcttttatttcaaatcctaaagactttgcaaaagcctgaagaaatgatccacatcctgctgaacatgcctcatttaaagttatgctttgtattgttccgtcttttattctaagacacttcatgtcctgaccaccaatatctaaaataaaatctacatctggacagaagaattttgcagccttataatgtgcaaccgtttcgatttcaccaatatccatagaaaaggcttcttttagaagatgctctccatatccagtaactccactataaacaatctttgcaccttcaggaatattagaatagatttcttttataattcctgctgctgtatctactggatttcctttattaccagcataatatgaatataaaatctcacatttttcattaataagaacagcttttgttgttgtagaaccagcatcaatacctaaataacactttccttcagccatgcttatatcaatctcttttactacacttttatcgtgtctttctttaaatgaatcatattcttgtttattcttaaacaatggttctaggctatctgatttattttcttcttcaccttttatatcttcaagtctggctaatatactgtgataatcatattcagactttccttcacagcttaatgcagcacctaatgcaacataaagttctgaatcttgtggaaatataacatcctcatccttaagttttaaaacttctataaatctctttctaagttctgacaaaaaagttaatggtcctccaagaaaagctacttttcctaaaataggacgcccacaagctaaaacacttattgtctgaactactacagcatgaaaaattgatattgcgatatcacacttttttgctccttcatttattaatggttgcacatcagttttagcaaaaactccacatcttgctgctattggatatatattagtataacttttagcttcttcattgagcttccctgcatccatattaagaagtgatgccatctgatctataaatgcaccagtaccaccagcacatgtaccattcattctctgttcaacaccaccattaagataagttatctttgcatcttctcctccaagttctattacaacatcagtttcaggattattaatctgtatagcctttgtacttgctattacttcctgtataaattcaacattaagcttttcagcaagactcattcctcccgatcctgaaatagaaaatgtaagttttttatcttttataatactttctgcatcttcaagacatgatttaaaggcatttctgatatcagccagatgccttctatatgttttaaataatattttttcatcttgattaatgactaccattttaatagtagtagaaccaatatctactcctatttttaaaatatttcccattttttcctcctaataagggtatatgtattaaattaattgcaatattttgtacaatcatatacttgtacagaaaaaattataacacacatactctcccagtataatagaacattattaacaaactatgaattttataaaattacatccatttctaaataagttctattaattactgtattttatccttcaaatgtttattcaacttattatattatatatgaaattttatttataataaagaagtaatcatttactcaaaatcaaaatcaaagccaatttaaatattttgttttcaatatattcatataaatacatagtcaaaatttttcatctttcgactatgtatttatgtgaacctgctttcattttttaacatacaatacatagtttctatagttcttgttattaagtaattacttctagctttatttatacaattataatagtgatatattctaattagtgaattttaaattaaacagtatgtttatttaaacaataatatgctttctcattactaactttaacataattaaaaccacacttttcaataattctttttgatcgattattatttaaaaaatgagaacatataatacatttaagtctttcttcattaaatccataactaataacttctttaagtgcttctggcattaatccttgtccccaatatttctctaataaaacataacctatttcttttgaatctttatttattctattaggatattcatgcaattcaacccatcctataactttattattattttttagttcgactgcccataaagaatcactagaatctattataaattgctttaaaattctaagactctcacccttgttcttttttactttaaaacctgctaaccttgccacttgctcgtttgacataaactcatgtaaatcatctaaatcagaaatttgccaaggtcttaagattattctcttactctcaagtatcttcatttttaagtttctcctaaacattgttttaaaaagctagttccattttaacaaattcatcctgtcctaataacgtatcctttttataaatgtcaaatactttaaatcctgattttttataacaattaattgcccttttattaaaagaacgaacctctagtataattgttattaaatctaatataaccgtataatccaaagcatttattaataactgctacaaattcattttttcttttttcctctaccgtaatagcccaattttgcttagaaataacttcccattctggatagttataaactgaatattcatcattatacttccaactacatatttctctagcataattctcatctagatattctaatttaaaaaccatttaaaatcctccataactcaaaataagtcgtatgatttataaaaaatgattattgattaggatatttttttactctataccagtatgtatataatcttttaaaaccaagagacctatataagttaattgctttttcattaaatgaagttacttgtaaatatgctgtatctgcgccatttctaattccttcatttataattgttttacatatttttgtaccaagccctaccattctatactgctccataacattaatatcatataatcctatttttttattttcaagtacaccaagcccacaagctatcataatttcaccataatttatacttacacaaaatactttgttttttatattggaaagcataaattttgctgttgactttatagtttcctccgttgttccattaagttttagaaaaccatctaaccattcttctgtaatatctaaagtaattttaacatcttcaacttgagtattaatatttttattcaattgacaaatcataatatctgctgacttttcgatagtatatcctagtttttctaagctatcatccaattctttctcaacactttctgttatcttatacacacaaggtaatcctttttcaaagtacttgcattcgcaatatttaattttatcttctaattcaattgttgatgaatacagtggattcacactatttcccctatatgtatatccatttgaatatcttaaaatccacccatcatatagttctgtcaatattgctggaaaagcattaattgataactcttctatttgaataatttctttaatcatttttgcaccccatttttcatattaaatatcctactgtatataattagttgctaatttatatactttgattaactgctttatctgataaatcacacattttaagttctttaaccatcaaattactatgcttttttcttatatcttctaaaacattcccactgattttctcacatattcacttttataatttcttaatgatacaataagttcaacaaaaaagtatcaaaagccataataaatctaatcatagtgaaacctcagcatttacagtatatttcaatatcatttccttcactatctttaaattctaaaacaaaattattctttattttagttaatggaaaaactatttcagcctttaattttatcaatctctcggttaatttttctatattattgacttcaaagcttggaagacaattatctccccaaaaaacatcttcgtttactttagcattattaaatagacagaatctaaatccatttaaatcaaaaacactaaatatctcatcttttacctctaccttttgcgtgaaaaattcttcatagaaatttattgccctttccatatttttaacgcaaatgtatagggaatttaactttaattctagttccattctgtactcctttatagctaataaccttatttgttaaataggacaatttaagatattatctcttatatgaattttttcataaaatatctcttgtgtttttgtggacattcatctaatatgccaaaaatatcatacccatgcttaagataaaagtcctttgcctgaaaatcaaatgtatctaaatgaattagtagcatcctttatctttggcaactttctctatttcatttaaaatttttgaaccaagtccttcttttctatactcttctttaacccataaaacatctatatacaagcaattccagcaatacattttgctatttattcctgcaataatatctccatatgtatctgcaattactctgttaatccaaataaatgaagactcttgtataataggaactttagataaattatactcaactattttgtcaacaattaattctgattcctcttcattacttgctcttataatataattactcatattctcccctcaatctaattcttttttagtaaataaattcatttaattacattttctaactctatgataattaatattatatgattttcggttttttgagtagtaccactgggatagaaaaagaacaagttagtggattattaagaataagtaatgcgtatatctaaacttggatttaaaatatccaatacaaacaatcctttgatattttaaatccaaatttagtttgtaataacattgattctttattaatcaaattaattattgatacaaataaaaggtacaaacttgaacacaaccataacttccatgtgtttactttcacaatttctgctcctcataattttattatttcacactttaacgatttatcttaatttaaaatattactataatcctaaaattataatacataatattaggattataattgcagaagatgttaatattgataacacttctattttttattgcatattactaagcataatgtagctatcggtccaagaaataaggacaataaaaaccaattcactccagacctattttttccttgtgcaattcctgcattgatcaaagctaatgttccaaatcccacataaaattctttgctcatattaattctaccccttctaaatttatatattaaaaatactaataactattttcaaaataattttaccaaggtctttttccttgtagccaccctttacgtctccaatattctttatcttgatggccgtctgaataactattcataagatttttaaagatataaaacaatatctttgtttttaatggagtatgcacttttttatttttaagtgatttgtaaaaaacatatgctttattacccaaacatttttcatatttctcttgcttttttaatgacatctcattccaatttttagaccaaagagttaaaccgcatttatatatctttggaattccccagaaacttaaacttctttcaactgattttattacatattttgtaccagtacctgctgttgtagatactatgagtgcagtctttgagaacatttcttgtaatggtctatggctcataaaaatacaaccaaaatgatcaaaaaacactttaatttgtccactttcggcaagtgaatatactggagaagctataataataccatccgaaagtttcattgtttccaaaataggatgagtatatttagcatgagggcaacattcacctccaaagattcctttgtcaagacattgaaaacacccacaacaaaacaatggtaaatcctttggtaaatataaatcgaaaaaatcattgtttccaattaaatttaactttaccttaagtatttcaatggtcttttctgtatttccattcctctgactaccatgtatcacacatattttcatattttccaccgcctaataagtgataaattacatttcaccgaaattcatatttaatataaaatataaaagcctcctacattatcgaagtcatcataatttctatttactccttatttattcagattactccttttttattcctttttaacaatataatcaacaaagccttgtctaatttttttaccctcaaatattctttctaaaactctactctctttatataatattttcatgttattaaaatactcttctggttcatcttcatcaaaatatgaatgaattacgggaatataatcatccatttgctcatattgattttcacccatagctacacctgttccacagcgatgatcttttgtagtaaggaaattaacaaaaagaagaccttctgactttaatacacgcttcatttcatttatagattttaaaacatctgattttgtcatatgaaatactgaattgtaagaataaacaaaactaaaagactcattttcaaaatttaattttctcatgtctcctcgttcaatatttaaattttggttttttttacttgcatgtatgttggccttttctaattgtttactattgaattctatcccatgtgtttcatatccatattctgaaaataagcttagtggtggacaatctcctcctgcaccacaatccaacactttcttattcatagctgtctcattacagaacataataaatctgtataaaggtatttgtttaaatatttcattcatatctcctaaactacttctccctaatagaatataatttttgctatttaatacctactcttaaaatcattcttttacgtgttgtgttttattaaactatttttaatcaattatagcatattttaccaaatatatgtgcatacaatatgtatggcagttttaagctacattccaacgcacaaattatccattatatcctttcaatataattttttctaaatcttcttttaaattattgcttttatactctccaccatgaaagcatataattttttcaatatccaaattagtaattttcttaagtgaatttatttctgcttctttatctaatacaaatcgttcatcagcaatacttaatataccattttcacaagttaacaaatctccacttattaaggttttcataggttcaatataaatagaaatatgtcctggcatatgccctgatgtttcaatcacttttactccatcacaaatagtctcattatcctctactactaaagcaaactccaaaggttccacgctttttatcatttgtataagtccactgtctgcccataacatttctccttgttctaacctaagtggtttctttttccctataatatatggtatttgcttttctgaacattttacctttacagaaggatatttttctacaagctcctttactgcgcccatatgatcatggtcatgatgtgttaaaataacttgtttaagttgtcttatgtccaagccatttttctcaaaagcctttttaattaatggcaagaacataggaaaacctgtatcaattaagatcaaatcatcattatttttaagtacaactggataaatataaaatctcatttctcccatttcaaataataattctaaagttattaattcagtcatttcatttcctccattttaattctggtatctcccattcaatctcatgcaagttagttccttcatctgtcatttgtcctatactataattatatatgtatccagaactcgtaaactcaataaatccatctattaataattcacttatcttttctacagattgtcttattttagcctttaataagtcatttttaagttttaatatatgatttttaagtcgctccatttattttggcaacttaaccaatactctgaaacttaattttttattcttttggctatttcttctatatgagtattatccgtaccacagcaaccaccaaaaattttaggattaaaatactgattcaacttcatcatttcattagcaagactaacattatcagatgattttaaatcactacaattatctaattcttctggtgataatggtgaagtatttgcttgtattccacagaaacgctctcttaccaatttagtcttattgaattgagtagacaatgcctttcttaaaactataggatgaacacaatttgtcatataaccaattggtttatgtactgttgcattatctatatttataatagcattatgaatagtagttccatctattagcttcccattattcttaatcataaagctaataatatatggtaatcctgtactttccatagcttttgccattcctatagcctcagataaagcgggcataattcctgcatataaaaaatctacacctgaatttttaaataaatttgattgccatgaatgaaactcctgagcctcttctatagataaaatctctgttcctttatatgcgtctcccttacatcccattaatccaccaacaaacatattagttgttgtatttttcttaattttttgtaaaaaatgcacattatcttcaataatttttccacttaaattagattgtaaaactcgctctttatttgctcttcgagttggggttgttgcaataaatggcaagctatatttctctgcaattttcatatattctctaaaaataatttccatagcttgtcttgacttatcatcataaattagattagccattgcaaccttatcatcaaacctaatattatattcccgttttaatctttctcctaatgcaccctccattaaaattgatgatgatgtattaaagcacgtttcaaaatccaactttatcacctaatttcttaattattaataatagtaattcaataagatctctcaattcctaacatctactaatctgctataaacaagattttacataatcaattggtacgtccattcttatagcagtatcttcaattgataaaccgctgtttaagaatcttctaacaaccataattatattttctccaacttcaacaatgtgcttatcaggatcataaaaacgaacaacacgttgtccccaggaatgttgtaacattggatgtacatagtgaatgtcagcaatattattaatcttttgaataaaatcatcaaaatcatcttcttcaaaatataactcggctgcatttcctccaaaaagaatttcattttcatctttatcaatataagtagaccaagtatcttttgtctgtaacgtaattcccccttttaaagttacatttgcaccaaaatcaacaacaacttctaatccaagcacatcataataaaattgctttgccttttccatatttgtaacaactatcaatggatttgaaaatttcattttacgtctccttataaaaatctatatataatcattatctactatcacttaatatctcttctcctaattctaatagatacattactttttaaactgcatttgttcctttagataatcttctatttcctggttatttaatttgcgaatttgagcattaggactttcaaaatattctttagaaatatagacaggcttcatatatttacatggcttatctcggttctttaataaatatttttctaaatcttcttttgtatgaaagattttatatgaaactctattgttctttcctgtaatttcataaattccacaagtgtccttacaacttacttccgctgttctcaaatataatttagcaaattccaatgttttgaatggaaaactccatctgtaaacatctcgcttatcatctttatcaatacatatacatcgcccacatgttgagcatatatattgtaaatgattttctaagcaatgctctggctttaaaatcggagttatccttggattatcactatagcactccctacatctcatattactttccaactttctttattgaatttactaaactaaatataattctcgttttttatgagctttagaatactcaaaattcttattcaacaaccatctatcatttaccttatatatttttaatcattattcattataaaactactactaatattattaagatcatcaatatcataatagaaatgattcaaaagttggcatcttgattcaaccattcttctttcctccagcaatctccttttgaacttttttactcaaagatttaaatactaattcataagacatattaatcatttgctttaaaatattatctggtacatcaccatctaaatatacagaattccaatgtattttattcatataatatcctggaacaacatgctgatactcttctcgtaaaaatgaaccaaaacttggttcacattttagagttataatttcttttttatttttatcttctccttgcatggcaaacattttatcaccaataaggtatcttgttgcttcccactctgttttataatcttttaatgctccatccttagaaagacaatattcattgagccattcatatttcatctatattaccccttccattaaatccactaaaattaagttcaagttataactcttattgcctgtctttgatttgtatattaccactgctttcattacatagattcataaccgtatcataaataacattatacttcttgattactttcatataaattcaattgcctctgaataattttctacttttttcacaacaaaatatttcgtgaattctctcgtccacatatccatttcttgcgtcaaccacaaaattactattagcatattgtttcatcaaccctaattttaattatatccataattttatattacaacttttatttgtaaatttctacttacttttgattttcggcatagtttattagaatctctaacaaatcttgttgaaaatattgcacctaaaaataataaacgccactcattcttaattatctgcatgaaaaaagagctgagattttattctcaactcttggttttttgattgaattttttgtcttagttgaattccccccaaaatagcatttttgtcagagtttgttcattagttaggttattcaaccatttattatatttccaccatttacatgaattgtctgacctgtaatataagatgcattttcacttgctaaaaatacatatgcacctgcacattcaactggctgacctgctcttcctaaaggcgtatcacttccaaaagaagatactttattttcatcaaatgatgcaggaattaatggagtccatataggacctggtgctacagcatttactcttattcctgtctttccttttgcaagcgctaatgcaagtgatcttgtaaatacttctagtgcgccttttgtcattgaataatctatcaaagtatcattacctttaaatgcaacaatagatgttgtgtttattatacatcctcctgatttcaaatgattcatagcagcctttgtcatataaaatgctccatatacgtttgttttaaatgttttatcaaactgctcacatggtagctgctttatatctgtacactcatattgtactgctgcattatttacaaggatatctatctttccatattcacttattaccttctctattgtacttgtgcaaaattccatacttgttatgtctcctggaattaatgtacactttgcacctgcttcctctactttctttttggtagtttctgcatcttctacttcatttttataaactattaccacattagctccttgatttgcatatgctatagaaactgctcttcctataccactatctccacctgttattactgcaacttttccttttaaagtatctccttttttattatattcaggtgaatcatatactggagctggattcatttcaacttctaaacctggctgtacattctgatgttgcttaggaaaattaactggaaaattcatttatattcctccaaaataaaaatgctcacttaatagtcaagcagtattttcttaaattttttgtgttaaatgctatatgaattaggtttaccatttaatctaaaattattatttctttaaattattattacaattatcttaactgaacttttaacttgtcttatagtgatataatttaacagtaaaataaattttataccgtaatggtatggaggtaattcatgaataaaaaaatattaagccttacattagcagcaatagcaagcagtactttaattacagcttgtggtaattcagcttcaacacaaaaaaatgaaacagcagattcatcaacagaatcttcttcaaatactgaggttacaaatccagttcagtcttcatcaattattgattctccaactactgaagtaactaaaattgcttctgttgatgactttaagggaaaagattcaaaagctgttgaatctattttaggaaagccttcaagtgaaaataataatgtatatacttatgaaaaagatggctatacatttgatataacatatttcgattcaatatgtggacaaattaaaatcacgccaaaatctttaatgaagtatcctgctgatgcaacaaattcattaaagattttaggtataacagctggagatgcagatgttctttcaccagcaaatcttgcatggacaaatcaatttaacacatatagtatttcagtaattccatcagaaactgacggaaataaactcggaagcattaatgttattcttgatgaacaatataaataatatgaaaaagctgattcataaataaattacgaatcagcttttattttccactttattatttttagtaagattatctataattatcacaggtactctatgacttattccatcatcatcattaatagttgtaaaacttagtgagcctcttatagtaacccattcattttcattcaattcagcaatatttttgccttctgcaagtattccaacaatttttgaatctgctgcacagcatgtcattatgattctccctattacaaattgagtatttttcaaatagctttccttacatacaaaaccatacatttcaatttcttttcccataaattcctctggacttgcttgaatatcttctaatatattaaggttattatcatctatttttataaattgatcatatttactaccttctattatattcttttgatctttctcttccaaatcttcactatattcattaataagaacattatttaattgtatatgtctaaatgaatcttgactttttacagacaaaattccaattaccaatgctaaaattatgggtatatatttcacttttaagtttatattattttttggtgtaaatatgtttctaatttgaaataatgatataatggttatcataatcactgaaaaatacacatatttaatcattttgtttccaatataaaattgaattttgcctgaattaaccaaatacaataatccaaatgccataaaaataagagtgatgaaccatataaattcatcccaattgaattttttcacttacacttctccctttctggtttacaacatatttaacttatatcacattaaaataattctaagaaataacttaacttttataaaccacacatcataaaaatacatgaaacaataaacacaattccaagtgttacaaaacttaatttagaaacaaactctttattaaaccctcctgaaagcattattaaattttttaaatctaacataggccctataagaagaaaggctgttattgaactaaaagaatatgttgaataaaatgtctttccaacaaaagcatcagcttctgaacataaagatagtgcaaacccaaggaacatcatgaatacaataacaagaactttgttttcacttatgaattcaaatcctttatgtgctgctacaacctgaaatatgcttgataaaaatgcacctagaattaaataccttgttatatctagtaattcacggttagtatgttctataagacttctaattctgctttttcctgctgtaataattgtattacagccacaattacataaattatcaaaatcagcttgtcctgaaataatatttctatcatctctgcatagcatatccataataatgcctattataactgcacaagcaaaaccacctaaagttcttactaataccattgatctatgatcataaaatgcataatacgtagacattataacaactggatttacaattggaaccgaaagcataaacgtaacacctaaccctactggaacacctttgcttataagtcttcttgttattggaacaatagcacattcacatactggaaaaattaatccaataagtccagcacctatatatcctaaagctgaacttcttggaatcatcttttctataatttcttgtgatacaaaaatttgtataaatgctgatacaagcgaaccaataattataaatggaagtgcatctaatattatacttgtaaaaattgttgcaaaatcacctatttcatgaatactgaatacaatgttatactttttataaatatatgcagtcagtataacagctccacctatcaaaaaagtaaatatccctcttattcctctcataagtttcccctctttcaaaatacgtttataaattcataagtttgactttaaatttctttaaacatccattatttattactttagactgccgtaatttggtgcacaaattaaatttattatctacttttaaaatgaatgctttcggattaactcctcttaatatattaatctctttcttcaactcagcatttttcatcttttctgtattatttataattatcatatctgaatattttataaatggaattatataataacctaaattatctatgttatttaataatttactactatctgccacaaaataaatcgttgacaatttcattaatttttttaattctctatcttctaacttttgtataagatcttcaatattgtctgttccattgaattcaattattattctattaggtctaaattttataatttcatctccaaaacgttttttaaaatctcctgtatcatcaaatttatatatttttacaggataatttacatcattaatctcatatattttcttatttccatcttccatctgaataactaatactttttctccttcaacctggctctccttcaaaagagaattgataaaagaagtttttccatagcctaaaaatcctgttacaacttcaacttcaatcttcaaactactcccccttcttattaattaaaaatccttttattaaagatagcaaagcagcagagtacatctgtagctatttaaaaagattatctaaattttttttatccaaactgcttccaataatcgaaataacttttttatttgaccactttatttctcttattttaaattcttttggaacataatcgaactgaaaatacagtcctctatcattttcaataattccttttgcacgaattatatttccataaacatttgtctgtgatatgaattcaaatttactttttaattcatctgcactcataaatttatccatatgaatcggataactttcaaaaatatcgtctgcacgatgattgttggtatttttctttattaaagcactgttaaccttgctaactgactttactatatttttagattccttaatactattcattgtattttctttcataaaatctattgcttttaattcatcccatggtttatatataatatctgcgttagaattatttttctttatagatttttttacagtgtcaatataagccttattttcaaattgagttctacttaaaacaattttatgggcattttttatttgatctaaataaaactccttaaaattttttatatagttttcataattttttacatcaattaatgtaaaaacatttctaatttcaatcatatgactaaactttatgttggtcagtatatttattatttcacttaatttagcaacacctgatggttctattattatattttctggattatatttgttgataacttcaagcacagcttcatcaaattttcctgaaacctgacagcatatacatcctgaatttatttctttaatttcaatgttgctttcctttagtatttctccatctattgacacttctccaaattcattttctattattacagtatttttattatatgcatcttcagttaaaagtttttttataagcattgtctttccagcacctaaaaagcctgaaaatatatccacagttattttcataaatttactcctattaaaacactaatccatgtaataatttatactattcataaccagtatatatgcagaaagattacaaaataatttgttttggacataatttttttaaaaaactctttagtagaacacttattcggtatataatatttctataacacatattcaaaggagaaaaaaatgagtggaaaagaacatatgacaataggaacctcggcttcaattggacttgttattggtcttattggacttggtaacatgagtataaattttgatatgataattttaattttaggagctattgctggatcatatatacctgatattgatagccacaaatcaacagcatctcaagtatttaataaggtacttatgtttataataattattattgctttattttatacttttggtataaaatttaatacttcatacatatattccttaaataaaattttgaatctcaactctaaaggaatagttttattttcaatacttacagtactcggaaaactctcaccacatagaatgtttacacataagtggcttggaactcttgctttctgctatagtactacattaatggggaatgattatttatctttaggtttttctcttgggtatatccttcacataatagccgatagaataacaaaaaacggaaagtatttgcgtttcttccaatttaaacttccaatgaaaaattcaaaagataaatttacaataagctggtaaaaaaatgctcctccttacgacagagattttatccctatcataagaaagagcatttttaattgaataatatatttttgctatggctgacgcattccacgtccacctttacccatagattgagcagatactccgtcctgtacagatgatgttatcttttcatttattgtaaatgacataattctttcaccatctttataatttccaccttcatacaatccactattggaaattccatcagagcttccaccaatatatacattatatgttgatcctgttttaaattctgaagaagcaacaactactgatgcatattgcttagctggagcaaatgtaactatttcattgccatcttcatcttctattctcacaatattttctgcactttgggaagataatgtaagttttaccgaatttatcgaagaaccatctgacggtgcctgtgccattccagtacttccagccgcaattaatactcctccacttacttcaaatgttccatcgtaatcaagtgcaccattaccattattttcaggaccattgacaattactgtaccacctgtcattgttgcgcatccattaacatcaataccatcgccagatgcatctacagtaataaatccaccattaattgttaaaactccagtaccagaggattctccaataggtccaccaccacctggcattccagatcgtgctccttgtccagtaccttgcatcttaggtgaagcgccatcagaattttcacttgaatcaggtgtattatttacagtattatcttgtgtaatactattagattcaccaggtgcttgttcttctttagctatgctgtttctctcttgtttcatagcttgattttgctcttgtgaaaactcattttcctgtaaattattcatatcgggaggtgacatattattttgattattactatttccagatggaggagtcatttcttctgatgtactgcttcctgatgcattaattccatcatcacttgatgtaacatatatttctccatcattaatagttatactctcactttcaataccctcatatgatttagatacattaatatttccaccatttatctccaatgtattatctgaatgtattccatcatctcctgactgtatctctaatgttcctccgtctattattaggctatcatttgtatgaagagaatcatcacatgaatttatatttaatattcctccttcaattattattcccgtattagctttaatacccttagaacttgcactttcttctaatgattctgatgatgtatttgagatttcttgatttcttcccatgttttcacctggtccttgatttttatgagaatcattattatcacttccacctcctgaatttatttttatctctccatttctaacataaacattattttcaccttgaattccatcttcatttgaagttatatttatgtttccaccttcaataagaacataacctttttctgtattttcatcattgtttgactgcataccatcgccaccagaatttataactatatctccaccagtaacaacaatggaatctcttccacgtattccatctccaacggaatttacagttatatttccattttctatttgaagatcatcttttcctacaatacctctatcatagttaccatttaccgttaatgatacattacctgtaaacaccaaatcagttttgctgaaaatagcaccattaggttcatctttattatcatcttcaaatgcatatgtttctccatcagtcaaataattatcagtattatccttcattgcaattactgctttatcagcttctttaatatatatggcagcacctttagaattagttatattgactccatttaatactatgtaaactttatctagctctgtagcctctattactatctgtccttcacttagtgtaccacttatgctatatgtcccaccctttgttatctttacaatgttattctcaatatcaacgcctgaaccctctgtctttatagatgctccaagctcaatatacgtatcaactttaccaatactttcactatttgcagatgtaacaggtattttactttcatgtacttcagtgttatataaagtttttgaacacccagtcaacaaaaagcctgttgtcactactaatacagttaatatagatacaagttttcttttcatttaaaacgtcctccaaacatattactacggtaagattcacataaattgtatacatacaaagtccttaccacctttatcttatatttatattatcatgacagtcttaacgttagcttaacaagatgattactatattttatcagtattcttcaatagaaaatttcattatattttttattatttaataaattttgtgatattatattacaaattttaatatactattttatcattaaaatctaaaaaggtgagaataatatatgaaatttataaattctataggtgataaagcgaaagatacactacttcagtcaatcgcagctttattagaaaaaaatccacaaagtaatcttcccaaaatagtaaaaatgtcaaaattattagtttctgataaatcatcatgtgatatgataaaagattttgaaacttcatacaatgaagttccagacttcaaagcatatattgatgatttaataaacaatacagattataaaatattaaaaaactttatagtaaatattttaggtagcaatattagtgctaaaaagaaaaatcatatttttctttctgaaaattcctctcagcctcgttcattgattataaattccaattcaaaaactcaaggtttaaacacattaaattataatgaacttgataaaataatttctgaatcgagaaaaatgggaattttcgcctttataattaatggctccgaactattttcattaaattatcttcataacatttatgaaaaatattctgatagcttatttattcctgttgcaactggtaattgtattgacgattctttatgtaaaaaaattctcaagtgtggtaatgtcattcctctatttccaagtaagaatagttgttcagatatgctgagacaaaatggaattccaagtttcaatataaactatattcatagcttgtttaaaaaggttaaatttaataatgatttctcaaacttaaaaactttttcattagaatttaatgattctacacaaaatgagtttacaacatattctttattagatttggtaaaaaataaaagtatgtaagaatatttaatgcccaattgtattattaaaacaaataaaatatcgtcgctataaaaacgacgatattttcatgtactataaaaaataaaattacttttgaattatgcacttatctaatatttctttatattttagcttaattttgtatttataatcaaaatataagttaagtaatattataatactacttacaaatttgaaatatgaaaataataagtatattaaaattaactgaaaaattaatactttgcctctagatttcgtaaacccatatataatttttgttataatagacactgaatcctgcaatatgaagaaaagtataatatactgtatggatgtaatcaatattgtaaaatacgaatatctatctattactatatatgcatttataaatgaaatagaaattatactaaatatccctaagtaaatattctttcttgaacatgaaataaactggccataatttttgaaatttttaattatattacttttattaattgctaaatcatttaaaatcttaaatctttttgcaaaaagtactgtcactatatagccaataataacagttccaagtggaaggcatgctatacttaaatagaatattaaatctttataagaatcaagtattgatggtataaattccataagttctcttgactcctttaataaactatatcctgtaagtgtactaaaattaacatccacagaaatcataataatacatgcggctatacttgaaaaaaataaatcatcaaaaatactttcatctttttttataaagtatgcaattaccatgcctaaaatcatattctgactcatcattatacccgatggaagatctccaattacaaatattatcaatattaaagatgaaacacatgacattattgtatatttcaaattacactttagcaagattattccaaaaaaagctggaacaacaaaatctatataacctaaatatccaaatcccaaacctatgcataaaacactcaatacaacaaatgctgaactgagcattgatgcttcagtgaattttttcacatccacttttatcactccctaaaaactttggtgagttcgaagtcttatttatcttaatgtttctttagttaagtaatgataaattagcttaactgtattttcaagtgctttataatgagttctttccataccatgagaagctgagacccctggtcctataagagctccacgtatatcgtttccgcctctaagagctgctccaacatctgatccatagaacggatatatatcaactgcataatttaacttgttagcttctgctaaatttacaaggtcagttaccatattatagtcatatttcacaaaaagaaaatcattaatacaaataacacattatttagtatattactaactttaccaaaaatcaaagaaaaatactttataacattttataagtagtatttgacgaatttttgacgtcaaaaagaaaggatatcctaatagatatcttctttttgcgttagcacatattttaataattcgttattatcaattcattatactttcctcttgctttagcttcttttgatacagaataatttacttggacttcttttatattaaactctttatataattctcttgataaaggatgatcatttattgttaataaaaacttaccttttaaacttttgagcttgtctgataattctttgtgttcttcttctttaaaattatttccataaccacatgtttcaatatatggaggatcacaaaagaaaaagctatgttccctatcatatttatcaattattttttcaaaacttaaattctctacatatgtatttttaagtctatctcttaactttaagagtatatccttagaaaatatttgttgtcctggtctagttgttgttccatatccataattattaccttttccaccaaaactttgtgtgattaaatataagaatcttattgctctatggatttctgtcatatactctaatgtacaatttttatattcttcaaatatatctcgtccgctaaactcatattctagtaatctatctatttccggagcatggtactttatagttctaaataaatttattagttctttgtctatatcatttacaacttctattttgctcggttctttaccgaaataaacccatcctgctcccaaaaataactctatatagcaaacatgttctggaatcattcctaatatggtttttcttaattttgattttcccccaactctacatataggtggatttaacatatgatcaccttctttaaaatacttttatttatattttaccgaacatatgtttgtatgtaaagtgattattttttatttttagaacttaatttcttctatttaaaatttatttattctgttacgtttttgtcacaattaccaaatataataatatcatagtgatgataattttttaatattacccctaagtaatatggcaaagagtagcttatttagtatgagctactctttttacattaaaagcagtagtaagatttacttgaccactgaccagaaatttataattaattaaaagcagcaagtaagatttcacttacctacaacctcaaatgtattctatcacattatagtaaatattgacattattacatataaatgaaataatgtcttatgaaaggggacgattagatgaaaaagaaagtattgaaagtttttagtcttttattaatatgctttagcttaacttctgttagtgcttttgctggaacttggggaaaaaatgataagtcaggagatgtatgctacagagataacaatggcaatgtgcaatatggttggtttaaagatgacgaatacgcacaatggcattatgcaagtaaatgggcaggagttcacactgattggctttatgatagagattataatacttactatcattttaatgctatgggtactatggatgggcaaacaccttactttgaattaactgacggaagcatacatgatggatgggttaagatagatgaaacatatggcgactccgttgtattcttctgtcaaaaagtattaaacggaaacatttgtaacatatactatccttcttcagtaagccaagctgatttcttaaacggaaatgtaagtcatatttattgttataatacttatacaggagaaatacaaagagttgacctaaatactagtatttcacaatagtatatatattttttaagagtagttaaattatacatttattaactactctttttgttttttattctttaattactcttctacaagcttttatttaaattcatttttatatagtctataattgtttcttctgaatcctcaaaaatatctgctaatcttaagaatacttcttgttcttctattggcatatcttttattgtttcttctaaatcttttgtactcataaaccacctcatagatattataaataaaactaattaacagtcaatactttaattattaccaaatgcttaataatttattacaaaataaaaaagatgtctaaattaataaacaccctttttattttgctcgatatcttacttctattgtcataaaaaattaaataaagataattttaaagtcctttttcgtagctttctaccattctcttaaccatttctccaccaacgctaccattttgctttgatgtaagatctcctttgtatccttctgcataattttgtagtcctaattcagatgcaacctctgttttaaatttgtttaatcctgcctttgcttctggtactaaagttttgttactattatatgatgacataataactacctccttaatatttgaattattttctacactaatatcttatccaaagcaaaacttaatacactataaaattattgacatttatagcattcttagctgtaaatagttctgtataatcaataaaagaattttttgtaaagaaaaagcagcaagtaagatttctcttaggtgctgcttactttgtttgagagtttatataaaaataagcagtagataaaattacttactgctcacagaaattatatatcgtttgtttcttagaaattattatatcttttaatgttctactataaaatattacttcttcccccttatgttttttttgaactgaataattcaacttataaacttcacttttgaatttattatacatatctcttatttctggagtattatcatatgttaaaatccaagaatgatattttatatcttttattttattggccaatgatacatgatcctcatgtttataaaaattagtatataatgttgcacctttattatagtatggtggatcaaaaaatataaaacttttatgttctaaattatttataacatttcttattaaatcctctgtatccaaattatataatactatatcatttttatgagctgctatatatcttattttttgtattatatcagctttattaaacctacagtcaagtttatattcacctttctgttcttttccgccaataacacctgctttaataattcctgacctattagttctattcaaaaataatgttgaaaaacctaaattcaataagttttctttaaatttattttcttgtactcgcttttgtttataccactcatccatatttattattgtgttatttattaaattacacaattcatctgtataattcaatacagaataccaaaatgcatatattgatttatcataatcattaataataatattatccacttgattattaattagtaaagataatgctactgctgccccaccacaaaatggctcaacatatgttgatttatttaattttttttcatcaatcaaacttttaacaaaataagtcaacttattcttaccacctggatatcgtaatggtgaatatgtattaattgccatatgtgtatactcctttatttttaattttatatatataataccactattttttactattggccatctctaaattgtaacttgtaatttcctctttgctattttgttataagcctttttaaatgatgttacaaatttttcagcttcttcattatttttttctagccaataatcgaacactctcaatgactcaaaaatttctaaattatcattaaaccatttcttgaatttttctcgttctttccctttatatttatcagaatatggtccatattcttttattgtttccttagtaaacgatatttgcaacccattttgccaaagttgtgaatccccttctaaatctaacaaaaaatcataaatcacttgttctggtctaactgttcccggcaattttattatgttaccatgcttattgctatttattacttcttgttgttgcacatcgccatctaatacaaatattatgtttgcaaaatataaaggatcattcttatttaattgtagtaatacactacaaggtaatttactatcaatacatcttatatacattgaatactttttgagtaagttatttaacaaccatcttgcttctttatcttctgaatatatggctattttatctatgtttgaacccggcatggctaatactaaatcacttttcattacaggaaattcaggatttctataaaattttaaaggtccattcgctttactacaataataaacttcataatcattcatattaatactatcattatttataatcttttgagataataattcaagtaaagaaacactatgtgttgtaaatactatttgtaaattcaattctttagctgctatatataaaaaattaattaatttaacttgtgcaataggatgcaaagttgcttctatttcatcaataagtaataatccacctttataatttgcattttccttttttaattttttaaatgataatattgctgttagtatctgtccaacattatcttgtcctgctgaatttgttatagattcatattgatctgtgtttattccaattcctttttttctttctgtatctccaatatcaatcatatctatatgcacatctgagctattatcgaaattaagatttaaaatatctgcataattttttataaagtactcttgttctttttgtaaatctagattcttaacttttaatttagcatctattacttctcctacaggatataatcttgaaagtcccaaatataaagatggccaatccatttttctactattattatttataccatcttttgtttcaggaattattctaaatcttttcccattattttgccatgttgttctacatatcttgctttctgtgatagtattaacattattaatatcgcagaagttaactctacatttattggaaccacttttatcaaacatctttgatgctttaaatatttcactaaattcagttctaaactgtgaattaaatatagtttttccatctttaattttcatttcacaggtattacctaataatgctaatattgtagacttacccagtccatttctcccagatattgcagtaatatatttgcctaaattaatctttatatccttcaagttcctaaaatctattaattctatactatgtaacatttttcccccataattatgtatatatttaattactaatatgctataatagaggtaacagaatgaactctattataactatgaactcatgattgattggtagtcgcatgagttctttttattatctatatttacataatactacaatttgtacatactttccatattttatttaattctctgttttagagcaaaaaataaggcagcacataagaaattaatcttacatgctgtatttctatttataataattttcttctttctacaattaattcttcaagttcctttatatcttcaagtgttgcttgctttttaataaaacttcttgcagtagacctatttcttaaataccttgctttttctctattctgctcttgccactttttattagcctctgtctgtgagttcttcttttcctccacaaattcaccttctttctaatatttaataataaaataaattaaagcaattataattattactttaattagtatttttaaaattagagttatatttttcatattgattaaaagtgattaatgtattattattttagtaaggggattaaatcccctttttggatttgcaatttatgaaagaattcttgatatgatttcttttataattgctatttttataagtagcttgatgactattcccagtagtttatcaagcttttttaatttattaatcactttcttacctcctttccatacttcaattatactatcgatagtataatttgtcaatagtttttctataaaattccataaaaaataaggtgaatacaagcaaaatactcatattcacccaatgttaaagctatattgtgcaatctagccttacatattatatcatattaaagttcttaaataacattattatggagcaactgaatagtcaccttctgtatacatcttaaattcactccatcttctggttattaatttgttttaggtattcttcataccacataaaatgatatccatttacgctgagtgtaaattgtttatgtatagttccatctttcctttttctttttttatatgtcctattacacatatcatatattctatcagatgcttttatatttagtttttctccagcttcttttacgctattatagaattgattagtttctatacaatatggtcttttggtgacaggtaattctccagaatattttttgatatcatatatagcatttcctatccattcttcaaattgttctttggtattatttccatttccgtatttcaaatgaaagtttttatggcatgtttcacatagagttataccattagtttcatctttccttttttctttgcaccaattataaccatctaaatgatgaactacaccatcatgatttattttttttccacaacatttacaagtataaccatctcttctcattacttttttaacaaattcttttaaatcattgtctattcttcctttaatacgttcgtcttctgtcttattaggattgtagcttgtattattttgccctgagttaaacactttattattacaatgattacaataatatttaccatctttgtgtacatatctgtaatatactgaataggatatatctaatatttctccacagcaatcacatttgaccttgactatgtgcctgctttctttagggatatcttcagcttttatttcgatttctttatctaaatctattacaaaattccttccccatctttttttaaagctagcactggctttttttattggcatagcatatccaattttttgatagtgttttacgttacttccacaaatttttacttttatagtttccgtaattaatggcataattaataaacccccagacttgagttaaaaatttttcagacatttgttattaaataatagggaagagagtgtctgacgttctcttatcaacaaggctcatgacttccttatctatcccatattgttataataacatattaattattacctgtatagtctccgtataagaacatagatgcttcttttgtccttcttctatatagtccttctattcttttacctccgccattactccatgcttggaagttagctgttatggtttcaggatctcttactccattgcatatattcctgtataatgtacttcctaaaagtccatttgttttgctagttccacaattatatgcaaatgaaaccaatgcatcaaattcacattgttttagtattattcctctagcatctagatcattttttattacaggagcatattttctgtttatccaatcttttaacatggatgttgcttgttcctctgtcacataatctagccctcttatttcctcaccagtcattccatagcctagtgtcttgactcctacacagtcgtaataaggctcgctataaaaaccttcccacgatttaataaaatctatagcttgttcactaactgccccttcttcattttctatccaatgaccgtggctatcaaaactataatacttaccatctataagaattctacagttagaatacatatatcctttatctatatctaagtaataccataatccatcagcatcctggaaccatcctataagcatagcgccatctggacctaatctgtaccatttcccattatcaataatccatttgttagataccatgtaacaattatcatcaaagtaataccacttattatctttaggatatttaaaccaacagttttgataagcataaccttcactgtcaaatctgaaccaattgccatttagctgcttccaatctgattgataatatgttaaaccatctggactataccaccagcctttagagtctttattccaaccaacagtatattttttctttaatggtctattaacatttttctcatcttctaaagcccatagttccttaataatggaactatttatatctaaataataatatccattgtctccggtattgccccaactattaactattttaatcatatcttttttatatcctgtgataaccatagcatgattacctttataagcgcctactggttctgatggaattatacctttatttgattttgcattataaaaattttgatatactcttacaacaatcattataggctttttatacttaactaagtattctttaatttcatctgaatttaatgaaacatatgcaagtgacttatgacctgccgcttcagttaaaagtttatcagtccctatttcagacattttatttcttacatcaggatattcaatgttataatcaaaactttctttaaaacagtccccatatttaactaaatttttcaacgcctgtcttggtacaagtccactttcttgatgatctgtatcgcttctatttccatataagaaaccaatagaatacatattattatcaatataacttttcatttccattaatgcatgagctacacaacttcctatgctcccctgattttgaattggaatatcataatcaagttcaaaactttcaggaacttcaattttttctgaacttcctgaaaccatgctataatcatagtctcttaagtctactggtgaatctattgctcctagtaaaaatttatcttccataacaaaatcctccttaaaattaaaagtagacagccaaaaggctgccttaattatttattattgctattctgactaatactgctattaacacttgttgtagttgattcagtttttactttatttcgtgtattaatattattaattacatcttgggcatcttgaattacattatctgatattccaggtgtacttgtatctacagtaatacccattaaggcaactaatgcaaatatcaatgccactaatgtttgccaatcttgccctatatactttattaaatcaaatccaaaatactgtgcaattaatactactatagaaatagtagccacccaccatgccttatttgttaatcttgctttccaatcaattttcatttttacattccttctttctatttaattaaggcaaataatatgcctattaatcctgttataactccacctattgctgttctagaaatccacttaatagtatcctctaagtctgcaattctgtaatttgctactttaattttttcatcccagttttctgtatttttttctaacagtatttcaattcttactagcctttctttaatttcttgtatagtttcctgctcattcatgtgtcaccttcctttttcatatttccaaacgattggatattttaatttaaaaataggcaataaaaaaagacctattaaaagtcctaaattactgccttgcttatttaattttcataagtactctctataaataacattaaatctttatattcttcatcacttaattttttcttattataaaaattttcagcatatcctaatgctttttccttgcttatatatttagcttcaactaaatcataaatgtaatcataaatccaattatctgttttcattataaatcattctccatatctaataaactttgtttaatttctaattgttctttttcaagttcttctaatctctttttggctaatttaatttcttctgtatcatctaatattacttcatcattttctactcttataggttgtctatcacttggtatatcagaaacaatataattgaatacttcattttcttctactggtgcttttgtaaataaaatattaccagcagaattatatattaataatattttcattatttacatcctcctatatatatttattctaaaataatataattccaagtatttgtattagcaactggaagctgtaaccattctttaaaaattgcttgtccatttgtctctaatggaaactgttcttgaaatccactagtattgccactcttaaatctagtgacaattattcttccatcgtttctttcaaaaatagtacttgatgtaatattagtaatatcccaagcgaatacaaacctaggagtaaacggaattccagatacacttataacataaaaattaaatgcaactccattcatatttttaaattcatattgtacatttattggtttaaattgtccaaaaatacaacgtctcccacccatacttcctacagtagctgtaccagctactccacatatggtatttcctgctactatcttattcgcagttattcctaatactgatgccatatttgaagttgatacaccaactaatgtattaccagtaacaaatccatttgtattattatatctaattaaaactctattagttccatcagtattagtaataggtccaaatgcttggtcgccaacaataacttttgtgctattaccattctcatatgaaattgatgaattacttgataaatttggcatatttccagtaattttattaccatttacataagcagtttgtccacttaatatttgtggagctgttgccgtagcattagtttgagaagctaaattattagcagtaattttaccactaccattgtgatatccagctggtattgtataagaagtaccagcagttaatgtacttgttacagctccattattagccatagcaccatctactcgtccattatcaccttctccataataacctgctaataaatacttggggattaagtttccaccacctcctttaccctgtaatataaaatccgtaccattgtaacaaagattatatggaatgttagctttcatatttgttacaatattcccattgctatctttaatgttcttagctccataagaatttaaattcaaactacaattaccagtcgcatttgttcctacaaatagagttaatttagtgcctttttttaaagattgaatccttacattagcaccaatatatgcgttagttcctgtagcttctactattggataagcttcattttctattgctctcatttctgtatcgattttactgaagttatctacaaaatcttgcctcttaacattgtctgttccttccattagctttaatccgtaattagaacttattctcattttatcatctccttaatcataaatttctatatcatcccatttgatactttcagcactgttataagataaatctttattatctaagtaatcccatgaagtgtacgtatatttaaaatcaaatcccatatgcgaaggcttaatcttctttatctcattaataagtgcctgcatatttgttggaattcctttaatcccaacaaattgtatagtaaagtatttttccctgtcatgacgtattacattgcactcaccaccactaaagctctcagcaacaatttttattctatatgtatctgctacaccttttccacgtatagctgcttttatcacttctctacgactttcataactcatacttggattatattgaatgccatatttatcttcataaattctaagtccccatgttgcagtatcaacattaaattgttttaaaacatcttcaatctgccattttaacaatcctaattctaaaccttcaacataataaatagcctccatttctggaagctcataaataaattgtggtacatatttatataagttaacaaaatacttttttaattcttcctctgaaggcatattctctgcatacttagatactccatacttggattgtccataatacatctatattccctccagttcattccatgtagtaccttttttaacgtaagttgtattgatttggtttccttcagaatcttgttttgctctatctgcttcatttgccgacttaacattcgaaatgtctgaactaactaccgttggagtaggagagattgtttcgaatgttgtgttgttattataaaacaatgaccaagtgtctacatttgaatttattgaagatgaagaaataatttcaaatataattcttccatatctatttgcttgtttagcataaagtgtccatttcattccatcaataactataataaaatcctgtgttggaaatccagtacgtgtcaaccatccaaatgttggacaataaatttctgtattattagaacggattttgagttgaagaagtccgtaatgattgtttgcataagtagctgtaaccataaaagtaatgttttggtttccataactactacaagtttgttctgctactttataccatttctggtcgcctgtttcatccgaaccaatcatagctgtttttcttctgccattatcccaactggttactttatcattagttataccatctaaaactgctttattagcatggacatgattttgacttgtgtctacatcagcttgagtaatatatcctgcatcatttgttaattgagatacttttgttaaattttttgcatgataaattgtatttccaccatatgaaaattcagtatctgttaataacaaatctgtaccacctgtatgaccaccacgaatgacaatctctttatctcctgctaatataacaccgtttctactaccagttgtttttctaagttctcctccgccatttatatctatagtacctgtcatagtcccaccacttttatcaagtttgttacttactgtattccataatgttctctctgcacttgttatgtgctttacagtatcgcttatatgagttacagcactattccaagctgtgatcagtgtacttgtaattccatctaaaacagatttattatcatgagtatgctttttagaatcagcatcattccagtttgtacgttctgtgcttgtaatatgctttactgtatcattaatatgagaagtaacactcacccataatgacctaactatatctaaaaatgttttatcttcttttgacatcttaccatctacagaacttgttgctaatggaatagaattagcacttatggcaacccaagtactaccactccatctgtaagtaatatctgtatctttaacattaacggtccaaccatcctgtggacttggataatttgtacttaaatcagagaatgttgttacactttctttccaatctaaatctgttataacttcatttattttattatcaatttctgctttagtatatttatcatcccaaagtggcttattggtatttatagtattttttatactattttctgcatttatagctcttgtaacctctgtagccaaatttgtagttaacgtattttcagccgattttgctctgtttatttcatttgttaaattagtgttcaatgtgttttcagagtctttggctcttgtaatttcagcatttaaattatctgttaatataccttcagcactactagctctattaacttcttctgttaaattatctgtaatgattttttctgcactcttcgctctagtaacctcatccatttcggctttttgtgctctctctatttctttatttagattatctgttaaggtactctcgctagcttttgccctgctaatctctaagttaagattatctgtaagtgttttttcactagctttcgcccttgtcacttcatcactttcagctttcttagcacgagatatttctgtattaagatcgttaacaatttcagattctttattttctgccctattaatttctgtatttaaatctgtttctaattggttttctttttttacagctctatctatttcaaaatttaatgctctttgagtttcatttaatgcatcctgtacattattaatatcctctgcttctactgtatctccagtagtttcataagtaatatataaaactggctctgtagaaaatatcttaataatagttttccatggagttagagaaggtgtaaaagttgtatatgtatttatcttagttcctgtaagcttactttctgtataaatgttaattgtgtttacttcaacattatcatgtgctaattctttttcataaacaccagctattggattaataacttcttctattgtatatatatttccatctaacttatttaatttagaattgaattgtgtgatatccaactatatcgcctccaattctaaaatgccttttacggcaatctcatcttcagctaaaatacaattagataccgattcgtttaaatataaatctgtataatcaattacacctggaatatcaagaattaacctacctaactgtgctatagaaatatatttagtagttttaaatggcatttcttttaattcagtatctaacattacaccaaatttttctttgcatatatttaatatataaccatcagataattgtaatttgactttaatattaattgctttttctatacaacttacaaccgttaattctgctccaataggtgcctgtcctttacccatcttaggatatggatctatataattatttacttcattaactaattctttagtcgcagccttatgtccatctgcaacaattattattttaactgttccatccccatcccattgtggaattaccttacactctgaaactccagtacattctttagcccatttttcataatgcgcatcgttagcactacttggggtatttgaagcattttctaatattctctcaagatagtcctcatctgattcatcatcaacaccaaacttaattatctctatattttcaatagaaataataccgtttatattttgagaaaacatattaatatttcctattgccacatttccgattgttcctatctcagtacattcaacttcaattattgctatttctgaatcatcaacgattactgtgttttgcaccaaaaattctattgctgcttgatcttcggttcttgtagtacatacaactcttccagcacttattcgagtaccttctttcgctgatattttaatcttgtgaattgcagccgaaccctttttccttggtataccttcagcttcacctttaagatctaaaaattttcctgtggctgtttgagtgattccccgctttaacatctgtagtaatgatacccttctaaattttgcaatttcttctgaaaaaggcttaacagaattccaaaatatatctccttccatcgtattaatattagatggagcgtttgaaatagctctctttaatacatcttctgatgtttccttaagataatccggaaggtaattatctattgatattgtcattaattatcatcccaccttctcagtattttttaatactttactttgtcctttaattggagttactttgtactcataataaacttttccatttttccaagtaaaagaaaaagaatcaacactttttgtatttggatgcaccattaatgcttcctgtgtgattctcgcaagctccatttccgtagcttctttatttaattccttattcaattcttctctaccaaacctataagtatatgccttaaatctatttcttattgtcattatagcaagttggcaccattgtatataagcatcataaccatttaatatttttacagttccatctggattctttataaatgtcattgtttcaaaatcaatagcatatgacccttttaattcaaatgtagaattttctttcatagttacagattcaatactatttgtaggaaataaattagccattagaaatcctcccaacaataacagcattaatacccattacagcaactaatactctatcacccaccttaatagctaattgattactaggtgcgtttattgtatgtgtatgtgattctggaccactagctgattctgttgtaatattatcagtattttttaaattatccaaaatccaataatcacctttaggatattcctgtttaattccatctactagtaatccactttcagttacagttgctaatgccataccagttccataattggatgctgctattgatttgtttgtatgtccatgtactactcttgcaatttcattataaatatcatttggcataaaatttcctccttatatcatctaacgtagacatagcattcattgtcatgctatctgcatcacctaaattatgtgtaatttcagttacataataaaacttgtcatataaagatactttatctcctgcacgtatatctggaatatctttaacgcatttaaaagtccatgtatcttcacctgtagaaaacatagagtttgctttatcctgtcctgttgcataatcagttactttactatcttgtactattttttgtatagttccataatcatcagttccttgtttgaatactcctactataggtgaaatttccggactttcttccttacttttattttctccaagcacctttacttgagttacgactccatctaatgtgtttttacgacttggatcatctataattccatcaagtttatatataacttcatttgtgcctagttcaattaaatcaagagaagtgcccattctgtagcaatacaactttccacctttttgagcagtttctttaagatcactccacatcattgtatataatgaattttttcttctatctttagataatcctattcctgtatctgcaaaatttcctattggtatactccaatcattgcatatgttagtagctctttgagttgctgtatgaccatcatataacaataattcatcttctgattcttccaaataaaccgttctttctttacattcaagtgatattctcattgtcttatcgctttcatttgttgtccaaatcacgcctgaaaaaatcttcttattttcttttgaccagaatcccttatcgtaaaattctatagaatcaccttttgttaatcctattttatttgcaagtgcataattttttaatatttcaaaattcatagtataagaaatagtgtctatggattctttaagtgatccagataacgatagtccttctatcttatatttatttttcaatactaaatccataatatatcaccacctacgctttagttacaaaacctttatgtacatatccaccagatgagccccaataaattgataaccaatctccccactgtttataaacagtatatgtttctccttcgtatgcatatccaagtcctgtactattttgactatcttcttcatatacagtagcagtaataacaatttttattttatctccatcagagtaagtatcatcaccaaaatatctattaccataatcaattagtccaccttgatatgaactttgtgaattatctatatatccgattaataagggtttgtgagttctaaatgctatactgaaatatatatctccgacttctcccccccttacttccggttcaaattgacttatatttactatctcattaatacttaattctgctattattaatctaagctgaactgtatctaactctgcatcaacccattcattaattttattcatatattgttgcggtgccattgttggcatacatacacaataactttcattatattcaataggaaataaagaattaaatgatgtttctcttacattttttccatattgttttatatcaacttcaccaacatttaatacttcttctgtcctgtatcttctttttttaggtgctgatatcttttctaatggattaactgggaagtgaattgttgtattactgaattcttcaattaaatatatatctatctaaatcagctccttctaaaactccaatcgcttggaacttttacatagcaaaagcacctggaataaatccaagtgctctataattatttttctatttatttatattttatcattaattttgtttttattttctcaaatttttctcaaaatattatcattagtttaaagtgaaattcttatcattcagtgacaggaatttcagatgttgttccacctctattaaaagtaatggttactttactaatatcattttcggcaacaaatggcatatatattttacctttagtgttttgtggtattggtgtacttcccatatttacatcatcaaatgacatagagaaatgatctagcatgtagttattttcatctttaacagtgaacgcattatataacatcaatccttcataatttgtattgtctttgttattgaagtccatattttcacattctatatttaataatattactgttttttcggtattttttttacttctttgccaccaatctgttttggtaacgcttttaatcatgaaattgtatgatccatgttctgtattcacttcaaaaggtttatctatttcaatcactttattttggttagaatccttttttaggctatctatattagtcttagtttctgattctgtagttaccttttctttattatctacagacttttgattacatccaaatgccataacatttaaacctatcaacattatgcataatattcttttcattattactcccccaacaaccatattataacttatttcttaatatttgagaatgcatctcttagattttgtccaaattgttgcatagcttcattaatcattgcttctacatctttattaccgttaatatttatgttcatacctccaaaactaaattgatttcctccacctgccattgctacttttggctggtatacttcaacctttcctttttgggctttattactttttaagaaatctatagattcattatgatttaatacacgctctcctcctctaaagtttctaacagatggatttgtgattatttcaaaaccttcttctgctactggatgtaatccagctgttgcattatctgttcctgatgcatatccttctttgtgacctgccgtatgtcctgcatcattactagatgtaaatgcttcagttacattttttgttatatttactatgccagtccatactttgctacctatttctcttaaattttctaaaagtcctccaacttctccttttgattcgcttgcattagtacttatatctgctgtagtaaccgatggtatttgattcaactcttctctagtatttcctatagcttctagtgctccactagcatcagcttttatataaacttgtgttccatttatttgtgccattcctgttattactccatctgattctttttgaatatcctgcatagatgcaacaatagcattacccattttaaattcacctgtgtaagtatttaatgtagaatttgaaataacatctattgcattaattatcccatcagttgcattagtatatgattttcttaaagtatctaactggtccttttgatcctctgaatatgcagcacctgtatcagctgtttcattataaaatcctgttatttcctttgaataatcatctactgcaacagttacattctcccattgttttgttaaatcattaaataaagtataatttcctgattcttttatacttgaagttccaatatgagaatcaatcatatttttcataatttcttgattacttatttcagtaccatttaatttatcacctgtatatttattaatagttttagccgctcctgaattctgatccattataatctgatacattgattgtttctcattccaattagaatcagcataagagcctctagtatttcttaattcatctatactcttttgtaatgatgattttttactttcttcagttgtttctgataatgttttttctaaaacagcaatatgtccatccaaatcagcaattttatctttgtatgcatcgtcaatatctttataagcacttttaagcaattcactcgcactatttgcatctgtagccttactagcatctgttgtaaatttagactgagcatatgcttggtcataggtgtttttagcatctatagcatctaatttaaggctattcatttgatcaatatatccttttatttcttctaattcactagatgccaattctctattttcagcataagcctgcgatgttatatcatatactttatccctggcaacttgaattttttctgtaacattatcataatattcacctattgatgaaactgccgaatcattttctgaactgtaatctccatctgcacttaaagcatcttttaaaacttttgtttcagaatttttcttgttttctaatgcattaataatatcataggcataatcatttattctgtttgctattttattttctctatcagatgttgaataaccactcatatctatttttttaatattcattaatagttccgttccactctttgcagtctctcttactgcttttttgaatgaatctgatattccttctccgaaatccgtatactttactcctgattcttgtaattcttttgctgatttataagcacttcctgtaaatttatttattattttttccccaatagtcaactcttctgtagctgtatctatgctcctattcattaatgagttatagctcattactccatactctgttgctgcaatacctgctgtaattgctaatcctactggactaaataaagctggtaatatttttgctgctaatcctactttgcttattcctactgctgcctctgtagcatctttagctacacttgcacctttgaatagtgatactaaattagatattccacttattgaattaccaattgaaccagctatattaaatccagctatagctgttacaacagtaccaattgctatcgcagtttcttttatatcttctgtgtgattagataaataatctactgcattaactataccatctgttatatctggtatctttccagtaaaccatgttacaaactgttttgcgtatggtgctagtctttctcctaaagcaatgttcattccttcaacagctgatttaagaatagtccattgaccacttaaagaatctaattttgtgtctgccattttcttagcagctccatctgctccatatattgcagtagttaatttatcataatcagatgtacctgcattaattattgcaagcattccagacattgcttcttttccaaataaatcacttgcagcagccgcttgtgtagctgtatcaagaccacccattttctctctaagcatatccattacacctttaagcgacttcatatttccttcactatcagttagtgataatttatatttttccattactgccgccatagtttttgtaggtgataccatattaactatagcattcttaagtgaagtaccacccattgaacctttaaccaattgtgttatcgttaggctctttatcctaacttctatacgtttcctgtatagttcagactatctcttcaccttcgacattactcgtttaggtgctacccactcgtggatatttctgcatataaaaaagatacctttgaaaggtatctcatttacttagcttactttatctagtcgttacaccttcctatcgtttcctttaggcttggctcggtattgccatattatatttttaaaatattataacttagggtttcaccgaattaaagtagtattttaagttgctaatttcttaacaactgggcattcttgtttacccgcattggccattaatcctagtgcaatacttgtatcctcaatactgtacttcatagctcccattgtagcaccaacatatttaaatgattctcctaaaagtcctatattagtattagcattagcacttgcttgggccataacatcacttaaatgatttgtatcacttgctttcattccaaatgctgttatagcatctgaaataatatcacttgtacttgctaaatcttcacctgaagctgcagctgcatttaataaacctggcatagctgaaatgatatcattggttttatatcctgccattgcaagataattcattccttggcttacttctactgctgaaaaagaagtagtggctcctaaatttttagctgtattagtaagtttacttaaatctgcttctgtagcttgacttgtagcctgcacagttttcatgccatattcaaaattactaaatgtattaattgctgtagtagcaccaaatcccccatagcgagggtacctgccagagctattgatattaccttttttgttcctgcctttaaccatgaagtaagcttattatttgctttttcaataacactactagcttgatcttctgcttttactttaacctttgcttctttattgtttaacttctcggtagcactctttactttatccaatccagacgtagcattatctttaagctttgctgtaggacttatagttctgtctgataatttcttagttttagattctaatttatctaatggagatgacatcttatcatttaactttgcagtaggactagcagtctgatttcctaaatctttgagcttcttttttgctttttctgctgtttcttctacttttttaactttattagatgattctttatctccattaacattaatttttatatctaatctatagatttctttggatgctattgcaatcgcctcctactttcatatataaagaaaaagggtgccttttacagcaccctataattattacttactattacgttgtttaacttcaatagcagagaatgcaaataacaactttcttgtcatataatctttcttcatcacatcatccggagacatattatgaagaagaaataaattatataaagcagctattgatcctccactacttattagttttttatatcatcttctgtaacctctacatcttctccaaatccacttaattgaagaatagattctactaaagcatttttttctccagctaataatttcttaattataaactgttttccttcactcaattcatattttgcaagtaattgagtattgttccagttaaaattagtagtagctgctataataactccagcatcatattctgcattatctaacttttcttcccacacacctttaacttttctttttctagtgcattcttttcttattctacttaattcatctcctgtaagacctttaagttctaattgtattccaagcctttcaagctttgcttttcctttaggtgcttcaaattcttcacccattaattttgctaatatgtcctcttcctttgatgctaattgtgcttgttgttcttcatttaattttttcattataatatcttcctctcttatttcaattaataaatagaaaagagtaggcatctaatgctctactctacaacttaatcaaagttttaatcagtttgtacaattttatcaagcaattcatatccatcaaatacaaatgggtattcattttcaattacttctcctggtttaaagtttataagactaatctttgttactctacaatttttaagtcttattctttcatagccatatgcttcaggatcatctaattcagaaattatttcaaattttttgaatccattttctatcatttttgaagtaactttaaactctttaagtgaaccagttccctttttagcaccagctttatgtccagtccattcagatccacaggttaaaagttctttcatgtctatttctacatctgctgttgtttcacttacctgtgtctgccattcaccatcaacaaaaatcttcccatatgtaccactacatactcttgaagcatctaattctccagacatttactacacttcctttcttattcagcaattattcctgttccatatactctcttaagtttcttgtaatgagtgacttgccaaatccaatacatttcatcagcttctgcagttgcctgcttttcttcatcaatttttacaacaaaatcatctgcgataattccattgttatttaatgtttcaaaatactttttaagtgaggataatgcaatagttcttcctgtatcattaccatcagcttttcctgaaatctcaaatcttttagcagaagtatcttcatttactgtttttaagaatataacagtctgtattgttccaaatgccttgccagcttcatctttgtaagtcttatatgtgtttacatcatcagcaacaacaactcttccaccatcttcataaagtacaatagtaccatttttaatagctgatgttatttgagtttttgataatttaggcgttacggaatcaaatattgtagtttcattactaattgattctttaaggcccttcccaattgctaatgctgcaatatatactaatacttctgcactattgtaagtagtgccattataagtagctgtacctagatataaattatttacaagataatcattataatcattagatctttggttagcatcatctagtgtctcagaattatttactccagttacaaaaataagaaatatatctccattttccttacattgagtattccatgtttggatagctgcttgtaatgcagaatcagcatatctatctataacaaaagcatctttttcataaccttcaaaaatagtcatagcatctatataatcttgatttgttattcctgcggttccatcattaccaccagtaaaattcttagtcgcaacattatctaaagtattcgtagttgagctaacttcacttgtcttagccgtaatatatgtgtttgctgttgcattatttattgtctttgcaatttctgcaaatgttccactaacagtaatattgaataactgttttgatccttcataaagtattatgtttttcttatctgaatctgcaacattagtttttactgttaccttaaaatctctagttgttggatatagagtttctaatgtaatagcatttaatggagatgaatctgttgtttgaagtactaaagaagcttttgatgcacttgaatctgccagtctatatagcaataattctttaggtttccctaataacgcaagtttccctagtttataagctgtataattgtcatcagttccaaatgttgctttaagagtattttctacatcattatttattaaaactggttcttttattggtccccagttggctgttactgttaaagctaatgttcctgttgtcccatttgcaattgtagcttcagcagcagtctggaatctgttataaaaacctggtatttcaggtttattatctgttccccatgttccctttgccattatttaaccttctttcctaagaaatttttcaccatcttatctacttctatttttgtaaacttatcttcttttgagcaattagaaaaagcacctgctaatactatttttgtatagccaagtgcttttgcattttccatatattcctctacagaaaacttttcttcatttactgtagttttaattgtagatgtagctgtttcttttgtggtaacatctttatttacatcagccattatacagcctccttcctatttaataattccctttccaataatgttttttaatttaggcgtattatcttctatcatttttcttttaaataactcaatagtcaactgacccttggttatcatatccgcctctttatcttcagttatgctcttaatagtaagatatctcctattttcaatatcataaggtattttcaaatcagtaattaaatgttcctcgatagtatcaagaatctgttctatttcagatttattttcacttaccacatgacatataagagttttttcttctcttataaccctgtttgtttctctcatcctatccttattagttactctccataaaattgaaggtacttgaaaattacttttccagttattaagatatacaggaatatcaataatacttttactataattacttaaagcatcaagccatttatctttattttcttcagtgtcttcatgtaatgcaataatagtaaattttaaaccttttgctattgcattccactcttcatctactatatcttgtcctataatcccatcaaatttgcatgtaaaactctcgcctgttttaggattagttattacttttaaatttaatgcttttattgactgctctgctaatttatctaaactcttaaaagaaagtctttcatcatacaaccatatttcaatacttctcttaaatccaactacttccccattatctgtatcgtcttttgcaacaacaacagaatatggcttttctgtctgcttgtctggtacattaggttcatagcatcctttaagttccgtaacttctttgagtaactgatttcttattgctagcctcatatattaatcactccaatacttacccacagcttctattataaattctttattattatttaaagtatcttttaatattggcataggcttaataccttttacactcttggcaaaatgtctttccccatcagtatcaacccaacttaatactttgccttttacaggaactatctttttaccagtaggtccgtatataccagtacctttttcaagccattctccatattctgtaccatgtgctaaatatacagaatactggctaccaccaccttctactccaccatttattccatttctagcatgagaacttctatctttccagtaagctttttctttagctttattaacaagtgtaggtgctataattcctccaagtaacattcccatgccaacttttttcctgttgatataatcaataactttaaaccccatgaaatcaagtcctttctaaatcacacaagtaaccacataaagtatcttcgattattattgggtaagctcctgtaacttttatatgaccttctttagactcaaattcaacaacattcttttcatctatctttatttcattctcattatttaaaatcatcttatatttatttgtagtataagatgttccttgagttttactttcaattgttattttgtttgaattatcttctaaatatattattccagtataagttattatattttcaactttctcataagcaccatctacaagaaccttttctgcatacttaacatcaaatgtagtaggatttattgatatacccttattgattgcatctataatctttttagattttaatctagccatcagcaaccatctgcccttctcattgatgttttatatccacttgttatacttggatttagcttagattgttctgctatatagtcagcttgataaatagatgcaaggttattccaataatcaggatcagcattttctatttctataggaccaacttttattttgctatctgtattagctttcattaaacagcctctccaacttgcttttaatacattgttgtcattgactgctaacagattgtttaactcttcatcgctgaatacaggatattgactttcatttaaattgatctttaagatgtctaaaggtgtaagtgccatgactattcaccttcttttcctgctccattgtcttctcctgtgttattatcagttccatcggcttctccactattgtcttcagcaggaacttcaacttcttgttcttctatttctgcatgttgctttaattctgcaacatctttttcagcaatttcaaatttttcatctttattaatgaatttaccaccatattttaaaaatttattagctgtaccaatatattttttaactgttattgttcttttcttcgccatactaattactccctctctcatataattaaagatcagctaaatattaactactctttattaacctacagttgcaaagaatacttcatctgctctatcaaaacttacaataggcattacagatactttagtatcaactgtaactggatcttctttaaccattgttgtaattgctgttcctgttccaaccatagtagtatcaagttttcctgaaccatgtgtcttgtcaaattcttcaggtgtaacaccataaactgtatttcctaatgttgttccgctcataagagtaactttattgttttcataatattgtactgctgatgctccttcataaggatagtaagtagaatcatctaagaatacaactgttattcccataacttctttagcaaactgtaaataatctttttgagataatattctgttctgattcataacattaccatttagatgccctttaattgcagtattaactaagaatgtattatcaaatgttgtctcagtaagcattaatgttgttggttttgggtaattttcattagttaataccttctgccatttctttacgtctccaactatatctgcacttggatcagtccacttatctgtagatgttaatgtgactttgtggttacttggtactccataatcaacaactactcctccatcgtttgcatctgatgaataatttattactccattctgaacaacctgtgctgccattgcttttggaataatatctgaaccctttaccaaattaacctgtccatcaaaaatttgatcagatattgctttaactaaattctcgttattacatcccattgctgatattaattctcttcttgtagtttcatcaattcctgttgattctttgaagaatggtatttctgtgctttgtactgtgatttctgcagataagcttctcatcttagcagctacatcaaaagtactttgtcttaaagcaattggtttctttttagcaccttttgcattttcaagttttgttcctaatacttttttaggtggaaatagtgatttttctagtgttggctctactggtaactctttcatgtaaagagctatgttttgtgaatttataaaatcttgtaaattcatatgtttttacctccttctatttaccaaatataatcattggcattgctgctttttcaactgctttattagttgtatctaatttaacagcactttcataaactgcaccatgtaccattactgctgcaatttctatagcattgtctgctactccatcggctgatgcagaatttttgaaatttaaatcctgatataatattccatatgctgttgttgaaccaggtgtatctccgctaactcctgttgtaacagcaactttaccatctgctgaaattaatgttccagcctctaatacttccttatcatttagttttgcttttacatctgcttttttaattttaataggcaatgtaataaagtgatctcctgcaattaatctaagctttttatgtgatgctcctattgtatatgaactttgatgcatatactcattcctcctttaaatttaatttttaattagctgcaaatgaactaatatcttttacctgttttaatgattctgccttatcttttcctagctgtgtagcaaaattagtgtttgttggttctttaccaccattatccactccaccagtattaaatgaacttgttccctttggatcaatattgaataaatactcatgagatttctgtaatggttcaagttgttcttttaaacctataattgaatcgccatcaacttttaacttgtcattatcaataagtgccataataagctttttatctttaacattaaaagctcctagacctttttctaacgcattattaaaagcaatatctgataacttcttctcataatcatctgttattgttttatttttgccttcaagctcttcaactttttcttttaaacctgctgcatctttaaactcatctttaagattagatatttgtgtatctctctcaccaacctgtttcttatattccttagcctgttcattcacctggtcgaatctacttttaggaacatatttaccctcgcttatatcctcaaagtcctgtttatctaattctttctttttatcatctggtaaagctttgtatgcttcttcacctattatgtctttaatttttgccattatatatttcctccatttctattatcattttttaacgtgttaggcccacgatagaaattaatcagttctttaatgtctgctgattaaaagacataataaaaagccttatttctaagactttaattcataggaacaacatatatattcataacatttattattgcgcttaccatcagttccactatcatacggacagtttattataggtgtcttattatttctatatatacattctacactgtaactaccacttaatatatttgcatatttacatacttttagattttctattttgggaatacgatagttatttttactcatatcttttgctattcatcagtttactcatagcctgtttatgaatatttatattattttcaagtgcaatatttaaagctttattcatttcttgagataaattgcgatttaaaacttgtttaattccctcaatgttcttttgtaatcttctagttagagtattatctaactttattaaatacttagttccacaatgaggacatttaatataagtttctgatagcattgctcctaaatatttttccttaatttgtggctcaaattcatgtttacagtttggattatcacatataactttcaacacttctcatccctttcaattctccaatcgcttggaactttacgcataataaaaacacctagacatctctaagtgctaaattcttactatatttattatatcatgtgtatcttttaaaatttctcaactttttctcattttcttctcataattcaaacaaaaaatagcacccacataaattttaagtaaatgctattcttgtatttcatatgagtctgacatgaattttctatattcatcttttgcccattgtggtgcatcatcttttatctgcaacccatcatctgtataatatccataaccttccttcataaattttggttcatcttgttccataatatcactctttcatttttatatattcttttaatttattttctactttcataccaaatatttgggcaaactctcttggattatctcccccaaaatattcagcaaatgcctctgcaaaagtttcagatggattctttcccccatatctgctaacaagctcaggtgcatctttaaaactgtatgctttatcgtagatgttattatactctaataatacatcatttataaagtctttgcaccatttactactgtctaattctctattatccatccattttaaagaatcagctatatgatgtccatattcgtgcacaaaggttttatatccacgtgcatttggtactgtccattgtgttcttatacatctttcaatatattctctattataggttttatcacagaaatactttccgtttaatacaagctcaactgcttcaggtctctttgggtaatagctataatatcctactggttctattcctgccttaacttttatagctggtaatttcaccggattaattttcttaaaccctttaaaatactcatggaatttatctaaccaattaatgctgtcttgcaataagtctttatttataggatattttctactatcactgaaattaatatcaaatgtatcttttaaatgtttgcttatttcttttttatttttatattcttttgaactaaactcaaacaccttccatgatacttcatcattatcttttgatgcaagtctagtatataaagcttttctagtattatcattgtatctacttatattaacttttacagttccatctttgccattaacttttactaattcagcaccaggcttattgtctgtattatcaattgtattaaagtctgtgctccattcatccagttccgtatcttcattaccttcaacccatttatttattcttactatagcatcatcaatttcaacaagccattctgttaagtaacacatgcagtttggatgttgaattggtgttttatctgctggaaatattcctgctcctaatccataagaatcattacctgcataatcatcacattcatcttgtttcccatgcatacgtgctccatgacttgggcttaagttccatttcattcctctgttaaatgggtttttctttgcggtttgaatttgtgtttctgcagctgcatgagtaattgatgttcttgctaatctttgcgcttgatatgatactttatagctatcaaatccagctttgaaatttgtagtagttaatctattctttggatttattaatacttcaaggtcatttgctagctttctagcattagcaccaccagcaatattcatttttataaattcatctatcttattgctattatctgaagttaagttccacaatcttttacttaacgtctttccatctttgtaatattcacctgcaactaaatttttaacaacagtatttgaatagttattaatattatgtttaactatctcacttagctttctgtcttttacaacttgatctacataatctaatataacttgtctttgtataatagaactttccatcatattatctttaatattaggatatagttgcttatataagtctttagtataatcattaagtaatcttgctatatctatatcatgcactctagttctacttatatcgggtaattctaatatctcatcaataagccttgtagctgatttagcatatatgttattaatctgtttttcctgttctattgtaagtttcagtatttttttccttgcctctaatacctttttcttataagggttcatgatacatcaccactattcttcatcttctagttgtttatttatatcatcaatctcactattcgtatcctttaacattgagtcctgagcattctgcaacatagtagtttcctctaaaatttcttcaaaggccttttctgcatcttcttcatttgtaaattctttaatatatgattttctacttctaacctttctatcaacttcatccatagctttatctttcttatcatcttcatctgaaggtaatggaacatttctctttattatctttgtgtaattcattagtaaccaatacttatcaaatattcctggataacaaaaagaacctacttcgataataaaatcaattaggttcaataaaggtttttcccagtcattaaatttttcatcacacctggccatcaaatcattgtaaagatatcccatagcttttgcacttggtatattatttaaatcagttatctttggcatatcaagcatttctctcatgtctgaatcacatctatttagatatgcatcaattgctccactattccctatattatattcttgtctctgtatagttgcctgtttcccccgttccatggcttcatctgatgttcttatagcatgtaatgcattaggtgctacagttagtttattaacatcatcttcattaccatcaattactgcttcagccccaaacatctgaaatcttaatgcatctgcaaaatcactatttcttttattgtattggttttgagaatctactaagtcggttacatcagattccccaaatttactattgagctctccagcattctttattagccaacatggaatagttttagatattgtaatctcattgtctatagttaattcttcctgaagttctgaatttaaataagtttctttcttatagaatggtttgtactctactatcttattatctgcatctagtgtcctctctaatggcttgtaataataagtatgtagataatacaccttatctttatcctcttctttaaatacattctgttcatcttcttcaaagaatattactttaagtagctttccatttttctctttataataaaaattctctatgctttcatatttaataacaataggttgtcctggattagcttctgctctaagaagtactcttttctttatagtagcctcaaggaatgcttttctagtattattccaaaaatcattattttcaaatacatcttcaatgtattttctaaggtcctcacaattatccttatcttttaaatcatcagctttaaatacaagagtaggttctttaccaaacatccatcgtgcctgttttctaagtaacggcttaattttgtttcttatttcttgtgtaggcttataatcaatattatcatctattgtccaattttgaccatataacacaggattattctttgctgcttctaaatcctcactcttgcctttataaaatatataatctcttaatacttgccttctttctcttatttcattccatggtaaatttaacagcgtatctcttacactttttgcttgtctttcttctacagtttccaaattaattcacctcttatttatcaaattatttcccatttttaaaatatagtatttataaacatttactattaaaaacttattatttcgttaaaagtctgacctttaaattcattacttttaataagcttagtatttaagccatttttatatttttataatttcgctaaatcaatgttattcgaaataattacccatttacgactttaatatttcccagctttttagaatatattttgtccttgtcttccatatggatcaacagcttttttgttaactactccctttcctttttggtaaattgaatcatcatattcttcaactttaaatcttaatactgtatatacaaaatatctaatagcatccatagcatggtcattttcttttataacttcttcaatccctttactacctttctttgcatcccatacatatgaactaaattcttttaaggtattctgacagcattcattaacgtaaaataaaccaatacttagtgcactagcaactgttcgtattccatctagtacatcattattagctggtagtatattcttaaagccatcatcacgtaattgttttataaaacttgctgcacttggatcaactattattcttactggtattatatctcctaagaatttttttaaatctcttgaatattgaatatcagccttttgtattcctgtatttctaccactatagtaatattcttttactatgtaccatttatcattaaaaagtccccacaaaagaaagacagtagcattttgggttccataatctatgcttacataatacttttcatatcttcttttaatagtctttactttgtgtatatcttcattgaacatatcataaataacaccttctgcaaggcaccataaaccaagaatgtatcgtttatagaatattcctgaatacattctcttatatctttcttttactctttcagataaacttaaattatcatccatagtaaaatgtaaatgaactgcattcttttcttctaacttgtctaaaaattcagttttaaaccaatgatatggtccatctgggttgcaattaaaccacattttagcaccatcaacagaacatcttgaagtagcttgatttacaaatgattgtggcatcaaagcaacttcatcaaataatacacctgctaatgtaataccttgtatcaagtcttgtgagccttcatctttaccaccaaataaatagaagtcattacttttcccatctttagatatagtaagataattttcattagaacttctatgatctttacacttgtatcctctgccttttaacattttcttaagtggctttataacatttcttcttaatgaacctatagttttaccacacattgcaaaattttcatcatcaaattcctctgttgcccacataacaaatgataatgacattaccactgtcttaccagctcttactgagccatcagcaattaggatatctttcctacatacgggagacaacgcattccaccatgttaatacttgaatctgtttatctgaaaaaggttgaaatttaaatactttctctttatgctttttcttactcattgttccatacctgtttagttctgccctttaatgcttctaagaatccatcatcttcaatttctccttcatcattatcagtaattctattagtttcagctttagttttttcaatatcaacttgaagcttcaactgttgaagtttcttgtattcaatatccaacttagtcttttcttcatctgataacagattacttaacttcgataatacatccattgctttcatcttatctgctaacttaaatttaattccatccttaccttctgaaacttctgatattatacttgtatctaatccaacactgtcttttaattttacatagctatattcactgatcttttgtgctccagtgttaggatctacaactggtatatcaattccatctttattcttttgccattgtggtacttgcttaactccaaactctaagtaatcacctatgtcagctagtgctatatctttgtacttttgtatcaatgttctttgtaaaaattccttatttaaatcttgtgctattaatttatccaactgttccttaaccttagtatttctgagtagcttatttccatttaccatggcagtttcataagtacacttgtaagctcttgaataagccttggtagcatttaaacatctagaatatataacacaaaagagcctctgcttatccgttaattcttcattctccatgacttctttaacttcatcagcaataggctcttttataccacattcattattcttttttgcacctgcactctttttattttgtgtgcatacttttttactttttgtgtgcataccttttttatccttgcaccacttatatctagtcttccatgacttaactgtattgatagatacattgtatttctctgctatttctttatacttcataccattaatataatcttcttctgccagttcataattttgtttatccatatctcactgtcaccacctcgctctgctaatatattatttatcttcttttttcactgttcttaaagcagttttctaaatctttgtatatattatataaatgatacgataaaaatggttcttccgtatttatccgtatatatgatatcattaatatatcatatatttaagaggtattaatcatgtgtaattcatcaatagatctgcaaaactttttcccaactaacaaattaaaaattactaatatattagaagatacaaaagtgattaagataagtttaaagtcacaaagtaataattgtatttgtcctaaatgcaatatcatatctaacaaatatcatggaacatatataagaaaagttcaggatttacctatattaggtaagcaagtattattagaaatcaattcatatgaatataaatgcgagaatattgattgttctaataaaactatagtagaatcttttgatggttttattagttattatagcagaatgacagagcgtttatctgattttttatgtaccttagctttggaaacaagctgtgaaggggctgcacgtatagctaaaaatatgaatatcaaagttagtggggatacaattataaaaatattactaaaaaaatatgatgaaatgaaaataaatacttgtagtagtactgttggaatagatgatttctcttttaaaaaaagacataattatggaactattattgttgatgaaaaaactcataaaccaatagccatattagatggtagggatggtaaaactttatcaacttggttaaaggataataagcatataaaagtagttacacgagatcgtgcaagtgcatatgctaaagttattgagcaagaattaccgggagctatgcaaatagctgatagattccatatacaccaaaatctattgcaagctataaaaaaagctctttacaaagaaattccttcaactataaaaattgaaaatgatattaaaactcaatgtagctctgaacagaatgaccacggtaaaaaaaatcctaaaaactgtggataactttacagctgctgagcatatacgcattaaattaatatataaaatccaagaaatgaaaaatgatggatattcaattagtgaaatatcaagacttttaggtaaagatagacgtaccattaaaagatacattcaaggagaagtacatgatttatgtaaacattccagaaaaagaaataacccatatgaaaatagagtaattagtttaataaagataggatatattgaaaaacagattgtagatatattattatcagaaggatataaactttcaaaaagcaatgcaaggcatatgattcggaaagttgttaaagaaaataacctaaagataaataagtattctcctgttagtgaaagtgttaaaactaaaaatggtgctagagatgaaaaatatatttatctaaagagaagctatatatttgattacttatggatggattctgaactatctgaaatagaaaaaaatcatatatatgctaattatccaaaggtatttagtttgaaaaagtgtattatggaatttagagaattatttaagaaaaagaatcttgcattattttatatatttgttgagaaatatataaatatagatattagtgaattatcatctttagcgaatggattattaaaagatattgaagcagttgaaaattctatttgtagtgatttaagtaatggatttgtagaaggtactaatagtaagttaaaaatgataaaaagaactatgtatggaagatgtagtaagaaacttcttgcagcaaaactaatgttagctccaaacggataaattaggaagaaccataaaaatgtaaggaaacgatcatataagaatgtacaatttagtttttataaattataattactcaagatttattgggggtaattatgattatagaaacaaatatttattcagaagttaaaattaatacattggaagatcttcataagctaaaatcaattatggaggtaaacaatttgaaagtaaataaaagccaaatagctagggaacttggtgttgatcctcgaaccgtaggcaaatatttaaatggatacgtcaaacctaccactagaaactgcaaatctaaagtagaagcttttgatcctattataaaagagcttcttggtaaagattcaattcaagtattttattataagcgcattttatggcaatatcttaaagataatcatggattagattgcgcacaatcttcgtttagaagatacatttctaatcactcagaattcaatgagtactttaataataggaaaaaaggacatatatccactacttctcctatgagatatgaaacagagagagggaaacaagcacaattggattggaaagaaaatatagaatttgtgttaaatacaggagaagttattaatataaatgtttttgtattaatactttcatactcaaggtttagagtatataaattatctcttgataaaacacaagatgtgttactttcttttttagatgagtcatttgaaacatttggaggcgtacctaaagaattacttacagataacatgaaaactgttatggatgaagctagaaccaattattataaaggaaaagtaaataataaatttcaacaatttgcagatgactatggatttaatgtccgtccctgcatagcaggaagaccgaatacaaaagctaaagttgaagcacctatgaaactattagatgaaataagagcatataatggaaccttagattatgaaggtctgcataagcttatttcagatttaaacaatagaattaatagtacatgccatacatcaactggcaaaatacctatattacatttagaaaaagaaaaagatttcttatccgaactgcctaaagagcagataagaaatcattacaaaataatcaccacaagtgttaaagtaaatcgccaaagtatgatttcatataaatcaaatcaatattctgtaccaccagaatatataggcaaaaaactaaaacttcaagtgtatgatgatcaactacatgtgtattataacacaaatttagttactattcataaaatacaaaatcagaaattaaattatcatgctgaacattatactgaaattagtgctttaacatttaataaaaaatcatatgaaatgatagaaatagctagaaataatttaaaaatgataggagaagtataccaaaatgaatagtacatatacacaacttataaataatttagaatatttgaagatgaagcaaatgattactcatttggacgaagttattgattttacaacaaagaataatttagcctttgtagatgctcttattaagctaacagctcatgaaattgattataaagaggcaaatatgattaaatctatggttaaggttggagcttttccacatcaaaaagaaattaaagattttgactttaattttcaacctggaattaataaagatcaaatattagattttttaacattacgttttctagaatcacaagaaaatattgtatttttaggttctagtggtgttggtaaaacacatcttgcgacttctataggaatcgcggctgcgaagcgacgttacagtacttatttcattaagtgcaatgatttgttgcaacagctaaagcgagcaaatctagaaaataggttggatgctagacttaagcattttagtaaatataagcttcttataatcgatgaattaggttatttacctatagataaagaagattcgaaattattttttcagttaatcgatatgaggtatgagaaaaaaagcacaattttaacaactaacataaattttaattcatgggatgatattttttatgatgctgttatcgctaacgctatcttagatagagttttacatcatgccaatgttgttacaattaatggaaagtcatatagactaaaagatcattttaaacaagacgaagactaaaaaaactacattcttaaatgatcgaaaacttacattcatggggttcttccgtatttatccgtatatatgatatcattaatatatcatatatttaagaggtattaatcatgtgtaattcatcaatagatctgcaaaactttttcccaactaacaaattaaaaattactaatatattagaagatacaaaagtgattaagataagtttaaagtcacaaagtaataattgtatttgtcctaaatgcaatatcatatctaacaaatatcatggaacatatataagaaaagttcaggatttacctatattaggtaagcaagtattattagaaatcaattcatatgaatataaatgcgagaatattgattgttctaataaaactatagtagaatcttttgatggttttattagttattatagcagaatgacagagcgtttatctgattttttatgtaccttagctttggaaacaagctgtgaaggggctgcacgtatagctaaaaatatgaatatcaaagttagtggggatacaattataaaaatattactaaaaaaatatgatgaaatgaaaataaatacttgtagtagtactgttggaatagatgatttctcttttaaaaaaagacataattatggaactattattgttgatgaaaaaactcataaaccaatagccatattagatggtagggatggtaaaactttatcaacttggttaaaggataataagcatataaaagtagttacacgagatcgtgcaagtgcatatgctaaagttattgagcaagaattaccgggagctatgcaaatagctgatagattccatatacaccaaaatctattgcaagctataaaaaaagctctttacaaagaaattccttcaactataaaaattgaaaatgatattaaaactcaatgtagctctgaacagaatgaccacggtaaaaaaaatcctaaaaactgtggataactttacagctgctgagcatatacgcattaaattaatatataaaatccaagaaatgaaaaatgatggatattcaattagtgaaatatcaagacttttaggtaaagatagacgtaccattaaaagatacattcaaggagaagtacatgatttatgtaaacattccagaaaaagaaataacccatatgaaaatagagtaattagtttaataaagataggatatattgaaaaacagattgtagatatattattatcagaaggatataaactttcaaaaagcaatgcaaggcatatgattcggaaagttgttaaagaaaataacctaaagataaataagtattctcctgttagtgaaagtgttaaaactaaaaatggtgctagagatgaaaaatatatttatctaaagagaagctatatatttgattacttatggatggattctgaactatctgaaatagaaaaaaatcatatatatgctaattatccaaaggtatttagtttgaaaaagtgtattatggaatttagagaattatttaagaaaaagaatcttgcattattttatatatttgttgagaaatatataaatatagatattagtgaattatcatctttagcgaatggattattaaaagatattgaagcagttgaaaattctatttgtagtgatttaagtaatggatttgtagaaggtactaatagtaagttaaaaatgataaaaagaactatgtatggaagatgtagtaagaaacttcttgcagcaaaactaatgttagctccaaacggataaattaggaagaaccattcatgggttgacatttatatattaagacttactacttctcttatacatgttctatgtctgtcacatgctggattatccttttacatatgcatcttacttcattagtgcctttcttatatcttaaataacatttaattttcactttctccaccttctttcaatatatctcttttcactattctttctattacttcatttcctattattgttgcacttataaattttatataattatcatcctctgccaattttctaagctggtccttatttaatcctggtaatctgtttcttatcgtatctattcttctttgatatttgtccatattttcttacctctttctaatttattacataaaaaaagaaccctatttctaagattctattaattttcataatattttctttcaattcctattgttttccacgttaaaacgtggtataatatatacataaggaaggaggtgagaacgattgatataataataaaggtacttacaatcatctggttgattatacaaattgcctgcaagcttgttgatataatcgatgatgataaataagtacccactcaatacttggggaactaacaattcccctcgtaaaaacattatatcatatcgtgaattgttatgaaatatttaaataataaccttactactatcattattgtcttgcttactttaaaacttattgattttaaaaatatttctattcttgatattttaattgtagtactactcattattaacattatcctatcttttataactagaaaggattgataaatatgaatcttaaagaaatacgtaaatctcaatctttaacattaaaagcactatctgaattaagtggtgttcctcaacgtactattgaagatatagagcgtaaagatgaatgtaaagtatctactgctattaaattagctgatgctcttaatgttactctcgataaactttgtagataataaattataaaaaccagtaaatacaatatattgtgccatggaggattttcacctcaccttcaatatattttatgtatttactggtttctaaggcttacgcagtaacgactaaacattattgtaatccctgcctagcattacatgctcattaattaaggggcttttagaatatttatgtgtgaggtatgtaagtgttcatgttagggggcatgtcttactagatacctcttacttaatattataactgttactcagatttatttttctcaagttcttctcatttttttatcattcttttattttatattcatttaatttaatatagtatttattagttgtcccattatgattatagctatattcagtaattcctatatatggtgtaaatgttatagattcatctccaccattatgtaacctatttatagtatatatgcctacatcaattatactttctcctatttttttcttatacggttgtaactctgtaacatgagatatattcttctcatcatttctaaataattgatcgaaatcaccatacttttgattatcgaataatgggaattcaaataatatatttaagttctttgtatcacccgaatacagactttttttatttttaaacttttctactattaagtcaatatcttgttttggtaccacaataatcttatttgataatacgatataaccatatattacattattcggttctatatttttgttttcaagatccatctcgagtgggtcaccctttataacaaataatttcatatcatcattttcatatttttctattacttcttttgtaacttcatcatcaactatttttacttcattatcatcattaacatattccatagatcttttataagtccagtaatttcctacatctagtggaaaataattcagtgttttaaattcattcatattaaatgtttctcttattgcgtactcctttggcttattcattttaaaagttatatacgccgtaataataccaataatgataggtacaattaaagatgtagatataaattttatcagttcatatttagcattgttatttgattgtggtaaattcatattgttcctctttcttagcttatatttttattctttatagtttctttcttaaaatattattaaacaaactctaacttaatactatgcatttataattttactatttctatattataataataaaacacccatatttctacaggtgttcctaaatttatttatacatccacatagaatcctctatgtttttaactaattcctctcttttcctatatgcagttgcttgagcaatattaagttgcattgcaataaatggaatcttttcttttgctccatagaaatactctataaatcttttatcttcttctagtaaatattctatatttgtatccattcttctaataaagctttgcatttccattatcttagcttcagtttttatcttagtcttaatcttttctattttccttttctcaagcttggttacttcctgttccatttgcttttccatatagcttgtaccagatatacttgattgtactctttcaccacagcctacacctggaggcatagtatcaagattaatatatttatgaacattcctcatttggttatctaaagatatgatttgctcttctaaatcatcaacttttcttctaaacttttggattttacttttgtattcataatatctatataattggctctcagttttcttaaataaattttcttccatgttatatcacctatcctttattaacttattttggtataatactagataggatatgcattagagaaatgttataaattgccgtttatagttctctaatgcttttgttatgtcaagctatattttaaagtactgcttagtaacttgtccccattctccattagtaaaaacttctatcattactttattttcaatcacatctgcaatattaaaactctctctataggttggacttccttgtttaatatactctattactattatcttatctgataatgcatatattctgcctttcttatatattatttcatctgtattatgacctttgcctttaatatcttttattattcttgctttatttcctatctgcattagcttgtacctccaataacctttttctattctctagctcccttttatgaacttcatttatttgcttatctcttaattctttattaggaccacatgaaacaacatgaaatctatcatataggtactgacaactataataattactacactcctcttttttacatttcataatcattccttctttcttggccttaactttaattttgcttcatgtaaatagtaatggtccataacttcctgtgcacttattccaagtgtcttttgtaagtaacttaatacagcttgtatttcatcaaaagcttcttctatagcatgagcatcattctcaggacttctatcaacaagagcttcaaatactgccatttcaaactcttttctttcttcatctaacttctgaatctgttcttctaagcttatatctgaaatatctatattcattaaagtaattgccttaacttcttttatttccactatattcaccatccttaaactactaatctcttatattcatttttcaaattttcttgtgataattgagcatatctttgagttacatctggacttgtatgccctagtatcttctgaactccttgtattgtcattcctgaatttaatagatatgtcgcttgagttctcctaaatttatgacaatggactttttctgtaactcctgctttttcttttatctttgcaacaatcaattgaagtgctctaactccaatatgtttatgtggcgctttatctgatacaaacacatgaccttcttctctacctgtaacataagctttaagatgtaattttgctttagtactaaaataaacaactctttgcttattacctttaccagtaacaataatactttgctcttgccagtttatatcttcaatttttatattatctatttcactgatcctgcaagctgtactatctaataactcaaataaacacttttgcttttctgtaacacatgcttctctgagtttttctaggttttctgctttatagccttgaagtattacctttggcacttttgtctgcttcaacttagcagcaggattctttaatatatactcttcattttgtaaccatccgaagaagtttttaagatatgttatatatccattggttgtacttgcttgttttccttttcctagaactgcaagaaacattcttaaatccattgttgaaattgtacttactggctttgtaaaatacatgtttaactttattaaaaacaatttatagctatataatgttttactacttaatccttcaagtttcttacatgcaagatataaagatgctttttcttctatatctgatgcaacaagatctgtacatttagtttgtacttcataatcgtataaagtttcatctattgcatgtttaacttccagctgcttctgtaaatcaatttctaattgtggaaataataaagttatttttccaattaatttaacactaacttcttcgttcaagttactcatttttatcccttctttcattattatttgattatcatatgagaatagaattatatatttatgttctgaattaatcctattctctattgaattgttactttatcccttataagtattgtgtagtattttaattataaaaaataccgcaccatccgaatattgatagtacggtaaatattatttcttaggttctattattattttcccatcttctaattttgcgattacttctcgatttttttctgtaagtcctaattctttaacccaacttgtaggaagtgtaagacgagtagtaaccccatttctgctcgaagtcccaccacttttattaaaagtgacctttagtattctttctatagagcttagaccttcttctactttattttcatccacatgcttaaattctttattttttaaaaagtaatccaataaaccaccaagtccattagttaaaaaatcagcattagttaattccttaaatttatctttattgactttaattaatagccatgttatagcttcttctcttttgcttttatcttcccatatatgtttaggtgctgctttaaattcccactctttaaatgtattcggataagcgttgtttatagctttaaatgggcttctatcaaatgtatattctaacattccacttaatttattttttctaaatattgcttcacaaagattttttcttatatcatctttattccactttaatacttcttcaataaaataaatagttacttcttttgcattttgttccgctccaggatctacccaaaatctatttgggaacctattaagttccccttttaaaatttttatatatatctcaactggtgtattcattattcttcatcctccaaagctatcatcaagtctgcaaattcatcataatcccatatttctaatatctcatctatatctactacagattctccgtcatgaccttcttctacataacttccacttaaaactaacactctaaaatctttatcgaagttttgtataaatctcattaattcttttgcagtatcacaacagctttttccatctaatacagcagtttgaggagttaatccatcatcttcacaacattcaatagcttcttctgctgatccgtaaatcataccccatgattgagttcccatttcccagtctttcatttgaaatctataatatacatttgatttttcatcatatttttctatcttctctactgttggtttattgttaacttcataaatactcatttgaattacttcctctcatctatcttatgtatttattataacttattcgttacgaatatacaatacatttacacaaaataatttatagaaagttttcgacattttctgtactatcaatattcaattttcaaagaacaatttataatttacttcgtcaaatctgcatattctgaactattgaacttctatatccttcggtactaggactaacattttgtctccgctattatcatcaattgatgaatatatatctacagtttcagaacaataattttcatcacctgaaattatagattcaatagtaacttccatttcatctggcaggtcttttataaattctttcaatcctttaatatttaaactcattactgctctacctcactttacaattttaattccatattttatataatcatcgccagtataaaattcttacattctgttcttctattaacccttttgctactatctaagctgtagcaataacattcttcacaagaaaaacaatctgctatattattttttctgctatacaaggtgtccacattattcgcacaccttgtacatatgcaattacatatcatcttcttcctcacttttatttattcttttgaattcaataacccacacatatgggttagtatcccatccatattcttttgttgtactattccaaagctcctgaaacttatccattgcatgtggtggccattcttctgtaaccccttctgcctttattccttgttctgttatatcttgtagtctttccactctcacgccaataaccttaagaaatattcttgctgcaactttcggcatatgaatgcttggtttccaaacgcccaagtttttttcctgttctctatctattggtattctctctccttcggaataccctgctttataaacatactctgctgtcatattgtctcttgcaaagtccccataggatttgatatctgccatgtttccctaacataaagtgtatctccagctttatatggtatttttatttttaatgataatcctgtagtattccttgaaaataatacatttgatttttgcttatcagatcctaaatatgtgtaattattgtccacatcttttataactctccttgtagttgtctttctgccatctaatatcgcattgaccattgctgtattaaataatattggtttcatatatttctacaccctttctgactttaatatccacatcttaagttgtaaaatctcttttttcttgaattataattagttgcaaactggcctactatagggcttatatctaataaatcatcttctaaattacattcttcttcaatttcatgattagttatccctatttttttaagtgcgtctatatttgcttcactattttcaattaaaatatattcaagctctccacagcttcctgagcactcaactatttctaaactatttaatacttcaagttcatattcattcttagtcactttaattcaccctttctgacatttacgcattaatttttacaacactcttgtaataaaatgctgtctgtttgttatcccagctaacattaactgtttcacctttgttgtaaattcgtactatgttcccttcctttggtccatcataattaaacttaactttatctcctaatcttaaagtttcctctgattcagaaatttcagttaccccttcgactttaggatcttcttcaatctcttcatttatcttattaatatcttcaatttcatctatgctatatacttcattatctgaataaactgcaggagatttccatttagcaaaatgtccatttggatatatagccatacaaaaattcttgtattgaataagtacgttattatctgcctttcttttaataaatttatcaacgtgcattttattctttatagtcttaatctgctctgacgttatatgcttatattcattagcaacaagtatttcatccttaggccttagcaaaatatcctttataaatattcctcctggttctccatcaggcttaaacgataatgtctgtccatctatttctacataaagcttcttttcaacttttactatcctggtacacttatctctgtatttatcaataagctctttaaatattggattgtccttattttcttcttttgtaggaataatattaacaactttaggctgttcatcaaacaagcttaattgaccattaactactattgatttcattcatatttcacctcactatttttacccttaagaacggtaatatttaatcaaagaatgatttcatccttctatctttgaatgattttttacatttatctgtccgctgctttattgttccagttgttttgcatgctcctctagctgttttatatccattttcttttataggctggtaattcaagcaaaatccacaacattctaaatcttttaatcttttcttactcctgtccatattcctcaacctttttaaagaaactttcaagatcatatctaaatctaacttttttcttagttccttttaactctattccattttctataacccatttaataggtatagactttctgtcagcttcttcaatgtatttcttgactgtttgtacatctattgcaaaagtactctctaaatctctgtaattgaatataaaatatgctttgaccttttcatgttttatatccgacatttcttttagttgtgtaggccttatacaactgaatggaatacttgaacctttatgcgattttaactctaatatgaataaatactttttccccataacttcacaatctgaaatattatgggcttgaaaccttacattttcgtttttggttcctccaaaatttccagttccatctttaaatctgtaaaaccaataatcaaatggtatagatttcttaaagtcttcttcaaataattttccttcgttctttgccataaattattcacctacttttctatataagttcttatattcttaacaaccatgtttattgtgccatcaccgtttcttacaatctcaaatttacttgtatcatgataagcttcatcattgatatataaatcaatttccttatcaacatttaatcttattcttttgaattttttctctacccatgttttatcaactgaaacttcttctaatccttgctgatttaagtaattagcaaaatcttctttctcttgtggcaattgatataataattcatctgccagctcttccacatttattacatcttcttctttaagtttatttttaatagcagttcttatcttttctgccttacctgcatcttcagtaatattttttctagtccagttttctgtagattgtacaaaagtcttagtcatatccctttcatttgttacaagagttgcacctaagaaattatttataaaatagttagctccatactcctctgattcttttgttgccttctgcttatctaaaataaatagattatatctttcatcattccttattggttttataaatacagctttctgaatcttctgtccacttgctggaagtcctgcgctttgtggaactattcctatacctattttgttatcaacaaactgaacttcatgagtaaaattcttaacataatctaactttagtattgctatcattggtccttggtctgtaataatagaacatgtaattaaatcagcacttggaatattacaattacctttcatgattataaataattgacttgcaagttccttagataatcctattaagtcactatcaattccatttaaataatcttgagcaacttcttttactatatttctttcagaattaaatgctgcatatttaagatcatcatctttaaagcatttctctatatgcttatacaaaaatttgtaagtatcttcatctaaatctaaactatattcatttaatattggttcttcagctgttgtatctaatacatgaatgacagcttcattgatatttatatcgttaatgtattccattgttttttctcctttactattgaatttgactttcatatgagaatagaattttgtaactatgacgtggttaactcattctcatatacagttttatctattcctcatcttcaaatgcataactatagccttcccagttatcaactcctgctccttctaaacgacttaatatattatctctttcttttaattcttcatattcttcatcaattagtacttttgaattatctatttcttttgcaatttttatatgctttggtagagcctttatatccgcttctatttgctttagtttatctacaatgatagatattccattattgctctttaaaacctgctgtggaacgaattttaatgcagaatcaagacttatgcaatatgctatgttctgcatataatcttttccatagttttctgatttctcatcagcaacttttttagttgatttaactataaattgtctttcatctgaaacaatctgatagtctccaattttaatatccattacttctccttctttcctatcttaaattctatctgcttcttatcatcaagcttaatttcctgctgctcatactttatttgcttcttacaaagctttctccagtttctatcattaagttttaaataacgcataccatcacctttaaaacatactgcattgtccatctatttcttgtcttttctttttgcactctcctatccaccaacgataaacatcttctccagttttccattcacatatcatgtttttagattttctatattcaatcattctttcaaacgatctaatatataatttcttgaaatttggataagattctaattccttcttttgattagatcctaatggacaaccaatacaccccaatctatcccatcccttatcatataaaatacaataaggaatattgttttcaattatataactccatacttctgtatctgtccaatcaactataggtcttatcatcaatttacctctgaaataattaatcatcttttgattacttcgctgcttactctcctgccatctgattccagttattattgtgtctccctcttcccctgtacgttcttttaattctgcacaacaatatcttgctactctggtaggtggcattgctctgttactgattaaactccacatagtaattagctttcctgtgagctttcccccaacacgcttagaagaaaacttattatatttattaaattccactattggatacctattaactttggcccatttattaaatatgttttttataaaatatattaattcaggtggatcaactgaagttggagaatatactgctttaaattctattttagcttctatacacatcatatatgctactaaactatctttacctccactaaatgctagtatgggtaatcttcctgttggtgtgttaactgcaaattctagtaatctcattacacctcttttaactttttctgaagtatcaaccaatagttgatattcacttctttttctttccaatcctctcacctaacaaatcaaattgcctttgattcattaggaaatggtattaagtttctctgattgactttactggcttaatttataattttcggagcttactccccagtgagtgcattttacgcatttactcttaacttttcggtaaatactatgtggctaacataatatttactatgcaacctggtataccaggatcgattgaattgaaactttatatctatagatcaattacttgattttctcctaacacttcttctatatttaggattgaaacattaaacatagttctgaaatgttctactgcttttttgaaagctttctttgcttcttctgaattaatgtgcataattgttctcttatcagtttttctgtgatttcctttccatgtaacatattcaaatgttataagaaattcttttacaattagttgtgttggtattctctttatttgttccattatagctacctcatttctatttttctttaattattcttaaatttaataccttcccatattcaaatcatttttaccttttgtaaagactcctttagccgaaatatatacatcatccataagctttaacatttggcttactctatcttttaatgcaggatctttaggaattcctcttttttcactatttcttatttgaaataatattgttgaccatctgtcatattgtctcattgcatttaaatgtaatttatacgctgtagaatagtcattatctgataaattgtatatatcattcattacttcattaaaattatttagatcttctgttgttataaatttacacttcaacattgcttgtacttcttccatttgcctattcccctttaattcataaattcacgtaatctataattacattcattatcaaaaacattcccaaatctcttaccacaactttctaatattcttcctccaagtgcttcatccaaatccattagcatttgtggtgtgcattctgtagaaattaatgttggcatcttatttgaatatctgacatttaatattggataaatatgattcatatctgctggtgtaatttctcctgtaagtcttccctttttgactttatctttaaatagatcgtctataataagaacttctgcttttttatatctgttgcttaacttgttatagtattcatcatccatagcattagatttaagctctcttatagcttcaagatatggcatatagactactttaatcttctgttctaataatgcttttccaactgctagaactatgtgagtttttccacctcctggctgccccatgaaacataaccacttttctttatcaagttcataaaactttgttatatattcagttgccatttcttttgctttttttgtttgaacattataaggcttataatctctaagaagttttacatcttcaggattaactccgaagttttcccaaagtctttttagataatcattttcataacattcacacctcttaaagcctttattggtctgtataaatcctgtatctctacatttaaaacacttatatttattttccatacaatgaatcgaagttgtatttcggtccttctgattcagtattctttgtaggcttggtggtagatccattacctttcacccctttctctgctttaaaccctttagttttccagtttttcaatattcctttaacatactttagatttcttactcctgaatcattagcttctttcatagcttcttctacccatttagctgaatattctttagacataatttctatatctgatttactaattgagttaatagttccaaatcccaattcttcgtataatgataataatatataatttgtattattaataactgtattattatcttcacacttttccgaataccctctgtcgatatctcgaataccctcttcggaatttcgaatacccttgtcgacatctcgaataccaaaatatttaatttttgatatatgaataattcttttttctatctgttttgttccttctttgtagatataatcaattgatatatatcctttctttgatagtgatgtaataatttctgaacatctattttttgaaagattaaagaaatttgaaaagtgatcattactcgcataacatccatctttgccatctaaactatcaatttcaactaagaaaactttttcctgtagagtcaattttgtatttaaccatatttcttttggaatccatattcccttaaactctctttctgccatctttctgtcctcctatgttgaatattttttaatcttctggatataatataaataaggtttttcaaaaccacatatttcattagagtttgggaaggatacctcttgcaaggtcctatcccatatagtttctaccatcgctcccttaattgggagcttattttatttattcatcagcaaatggtgttccttcaaatatatccttttcctctgattctgacttatcactagatttattattttctatattttgcttatcaacttctgtgaactctgtatcaactgcattataatgttcatttggttgattatctggatagtttatatttccatctatatcaccattgattacatccttattgaatgaagcctgatcagatttaatagcagtctgcatttcaatactcataggtccatatttacttaataataatttcaagacagttttagtagccatagaatcaaaatcagtagtccatagactttgcttaactacccaatccttattacttttataagattgactgtatttctttccatgtatctctaattcttctctggtcatatataaagctttttcaaatccatttattaatctgaaatatcctacatatccaactatctttgttgaaggttcaggattgtcattaaattcaatctctccagtaagcctattaatcttttttaagtcattttcgaacactggtgcagcatttattgtcttgtattggccgcttctcattgctagttgaataaagcctttatatcccatctgaaattgtgcaattttaccttgctttttatcattgtaaggcactatatatgcaaatcctaagttaggatctatgggtaaatctaatgttgctgccactactgcacttgccattatagaatttggctctgcatccgctaagcttggtgatttagcaacattaattacacttgatatgaatcctggtgctttctttcctaatatatcttcaaatcttttctttacatctacttgacacatcaatccttttactgtagtcctcgcagccgcttgtggttgattattatttattaagcctccatgaacatttgccattattaaccctcctatttacacttgctaattctcatatttacaaaacttgtagtacctttaagaactgtttcataagtaactggatatttatcttttagcatcttattatcaagactatctctcttaacttcaaacctgcttactttcaaatgaccatctgaagctttttttgcatttcccatttgtaagaaaagttcttgtttgattctctctttttctttttccaattctttgactttatcagaacattcttgatactgctccaataggtcattgtctaaattaatttcatcatcaactaaattctgctgctcattaatttgttcagtttcttttttatttcctgttggatctggtgcaactttaggaattatattattctcccagaagttctctccaatctctcttagtgctctaatatcatcatcatttctagggacaactttccacttaacttccttacctaataagtagattattaagaaaaactttaaccctgtgatccccatataccattgacattggcaataataactgtctggaatttcttcacctacccacatttttttcatgaactcactacctgttttaatttcaagtccaaacaattcatttttaggtatataagcaatttctccagtatctctgttttcccagtaagtataatcatcatcaagtattccaattccatcaatattagccgaaaagtaatcaatttctttatcaagcatcatatatggatattcaaaagttgttagtttaatatctgtagctttttcaaaatcctcctgaatccattctcttatgtgcggctccatacgtgtcccataaactgtgtgaatattacctttaaacttttctactaatccaagcttctcattgaatacagttaatgctgaaccgtaattactatatcccgctatggttcctatttcagaaccaccaattgaattacatcttgtacttaaccatgtctttctatcttcagtatcttttcttgaatcaaatattacttttgctgtagagaacagatctctattttcaataaatttaacctttccttcacctgtaagaattaaattttccattatctaaaatacctccttaacctatcttctcgacttcaacatcattactttcagtctgtgcaacttctgtaacaaaatattgatagtcatcttctgacattgattctaataatttatcttgtgctgctttatctaacgactcccatttatccatacagattactttaagttctccacattgtgccttcgctactttcattgcaagttcaagtttttccccatctgataaaccatctattagagtttcatttattcgtactctgctatattcatctacgctgataccttcaattggcatattagcagtttgtaacaattcagcaggtaatgatcttgctttactaatctttgatgtcaaattatctgcatattcttcttttggagctaactgattatctcttatttctgaaattctatcccaatctcttaagtatgaaatcattttttgtgcttcatcagcttctgcttgtagtggttcaatatcaacttcctcatgttcttctaaatacttagctgcattacctattgttgcttttactttctctatttcggattctattttgctatcaactgcttctgactcaagcttttctttgtcgtcaagtccaataagttcttgattcttagctgaaatcttattctgattaatagaaattaaatccttttgctcttctaactgtgaaactgattgttttttagatgattcgatagaagttattaattcgtttttaagtgtatctatatgagactcatgtaccttcttaagagtttcttttctctcctggaactctttttctaaatctttcaatgagctctgataatctgaatcagcttcatttatttttgaagtattatcgttagttaattccttaattttaagttcaagttcatgatctgcatttgctatgaaattattagctttttcaatctttccatttgctagagaaataatgtcctgaatatcttctctttctaatttatatttaagtgttattcttgacttttcagcttctccattagatttaattgattcaactttgtcattgaaattatctttaagtgacttagcttgagatattaacttatttacattctgtgcttctgtaacccttgcatagtattctttgatatcaacactcttccacttctcaccatcatattcagcaggtaaatcatccactattgatttaatccttgcctttaattccttaatttctctgttaacctcttctcttaccttgtaatacttttgttcaatatccttaagtatcaataatatgtgtttgttatactcgatattatctggaagctctccaaaccaattaataatatcttcttcactccatcctatttgaagcatactaagaagtgattctgtttgctcttttacacttaagttaacccagtcaagtggtctaaatatatttccatttaccaaactgtttacaaacttttcagtactatctgcaccttttccatcctgtcttacttttaagtaattagctttaccctctcttattcttctatctatgcttaatccatcatctaactcaacaaatagtgtagattcatcttcaccatgcttaataacttctgaccttctattcttattggtaaaagtcttctcaatagcttcaattaccgaagttttaccctttccattaggtcctttgaatatattaatctttgctgcttcaacttctctttcatctattcccaagaaattgttaactcttaaaaattttatttttgacattattaaattcctccaatctgtgttataatttacttgaattttttgttatgctactaggaacgttttggtcggggttcttggtagctttttccttaacaatttttattgcttcacttacactatagttttctttcattactaacctaactatttcatctgcttgctctgcataatttaataattttcccatatttatctcctcattggatcccaaactacattagtaaccctgttataaaatatataactctctgcatcttctgttactataagaaattcatctggattacatcctagtttacttaagaaaatcttatgtctccttttcaatttctttggattcttcatcactctttaacctcatttctttgattatctctaaatctaattcctggcttatactaattgtttcttcactttcccgtccattaacttctatgcttttaataagcttgtcccttaactcttccacgcttacctcctgtacttcttattaagaattttgttatttgctgcaccacttattttaaaattcacttgtctttcttctcctatacacattggacatacataaggcttgcttaaatctgtctttatacttatgttccaatttgaattgcatttattacactttgcatacattgtaattacctaaatattgctataatagatattgcaactatagctgcacttgcaattccatacacataacctaaaaccaatgctttattagtatttttagaatttttaactatccatattgcctttgtaacagcatgtacatttctatctattgttcctggttctgacataagctgcctttttaattcctgcaatctttgaactatttctatatgatccatacacctgcacctcctaatgattttcaccacatacaaacaatttggatttatcaatatcagtacttaaatacttcatttcatcttcttttaatgtagacaaatcaaatcctaaaccttctaaatattcagctattttttttgcactgctcattccttgtgaaactatatatactttcctgtaattaaatcgaacttcttctacttccttatctttttcttgtcttaatttaattactgcaccattaaatgaacaattatcccttattaatttttccatcttagataagtaactaagactatcatgtattctgtaatagcaattgtatgctacctcttgatcttctttcatatctgttaataaatcagttaagttttttgaaaagttgttaaaaattccttgatacatatcaagtttgtctttgtattttgaaagaactttatccttcttttcttctattttcttattccatttcttctcaacacttgtaattgctttgtgttctactctttcaataaagcttaataactcttttttattcataatccatctacctttctttaatatctttcatacattcactacagatattcttacctttgtaattacttatatctcttgcttctccacaaaatacacatgctggctgatacttctttaaaataacctgatccccatctacataaatttctaaagcatctttctcagctatatctaagttccttcttagttctattggaagtactattcttccaagctcgtctacttttcttactactcctgttgatttcacaattaatcatcctttcttaacaatagataaatactatattatttaatgcttctttaatcagttgctctaaaacttccacattaaaaaatctgattttatactcactttccaagattccaattatcttagatacatctacatccttagtttcttctaatacaacttctgttgctttctgaactgcttctcttacatttgctgttattggtttcttcatttttatctccctatttttatttattatgttaaactaatgctgttttgataatgtcaactttacctttccataaatctctttctttctctagttcttcaattcttctttctaatcttcgtctttctaatggtgataatggattgagttctccagtaagagattctatctttaaaatttcttctaaataatacattggattatcaaacttaggatttctagttaatatcccattgttttcataattgacaatgctctgataactaactccccatcgttccattaagtcctttctagaaaacagagtcttttccataacctattcctcctacattcttatttgagcattgcaaccatctatcataaatttgacttctttactaggattccaatttataatagcttgtctacctatgtcataatctttaactaatgtattcttgtatgaattaacattaagctttcttttataatctctccaaaagttgctaaacacttttttattaagttctctataagctggtgcatctgttccgcctaaaattgcaacaatctttttattagctaattccctcaaatcttcttgctgtgaataatctattgttgtattattttccaactttgttattctctcatccatcttctgttgcttgccatcaatcataagaattgcttcaagttcttttgacattttaggaatttgataagatcctgtctttcttatctgtggtaagacttcacttgtaacccatcttttaaactttttagcttgtggtaattttgaagaaagtattaagctgtaaagtccactttcattgattactgtagtttgttgtgttcttcctaaattatctatgatgccttgttttagggtatcatcttcatcaacatgcgttgctattgcattttgaggttttacatatcccaaaacttctgctacatctttacctacaaaataaggttctccattaatttctaatgctctaacttgtccaaattcctcgtttttaaaaatttgaatttctttactcatggcttcatctcctttaaatttgataattttaataatttgtggtaaaatttttcctataaaaaggtggtgtttttatgaatttaaactctaaaattactgacgttattacatcacaaggtgatgttttttcaattgagcgtaacagtattttaatatcccaaattaaaggtgtttttgataattcaaattctataaaaacaattattttaccaagcaatgctggtattctaaaaaatgactggcttgttcattctttaacaaatcaaaaatactttattaaagatatcgaaccattatccaaatctaacgaacttttaggcttaaaagctgaatatttatcagaatcagattataaaaaatctcttgaagataataataaggctactttttctataggtactataaatggttctgcaattgttggtaattacaataatgctactattaacaatggatataatctaagtgaaattcgttctttgatttcttcaaaaccaattgaagaccaagatgaattaaacaagcttattgatagagttgaaattatcaccgaagataatcaacctgtcagcaaaggaacatttgctaaattttcagaattattagcaaaacattctgatattgctattgcattaggtagtaaccttataaactggcttgctactaaatagttttacatatcttctaatattattttttgtatttctgctatcaaatcaatagcctgtaatattgattgacttgcatttgataatgatttaccaataacaactaataaaacctttattgtatttttattttccttaatttgctgttcattatttatatggacagtattttttttacacatttgcatcatctcctaactaactttttgttctcgtttaatttcaaacaaataatctacttctaatttaggaaataactttgcttgaactgtcagtacatcaaaccaagaaatttttgttcttccacttaaataatttcttactgttttttcactaacatgaagtacttctgcaatatcttttgtcctaattttatttctagtcatttctgctcttaaatttggaaacatatttgtccactcctttcttaaccgtattcggttatcttgattacagtataattccatattcggttaatgtcaacacttttttgaactttttttaccttattcggttatttttttgttgaccaacggtaaaaaaggttatatattagtagtgaggtgaacaataaatgggattagaaattataaatatcataaaaaaagaaaagggaatgacttcaaaacaattatcagaaaaatctaaagtgccaattggtacccttaacaaaatattaaatggtcaaactaaaaatccagcttatgaaactatatttgcactagctaaagctttagattgttctgtagatatgttttgtgataaaaaagatactcacattgatataccaacattatccaaagaagaaacaacattattagaaaactacaataaattaaatgcattaggcaaaaaagaagctcataaaagagttgctgaacttacagaaataaatagatatttaaatactactactgatgaaataacagcaactacagataatgtagttgaacttaacaataagaaaataacgtatgatgattttgaaacagttgctgctcataatgacaatttaacagatgatgaaatatctgaagctgatagaagaattttagctgatataaacaaacgaaatagtaaataacagatgaggcgttgttaatgacagaatatgaaaagctaattgttaaagcagaaaaatttggtgctgaagttagagaaattgactttggcactgataaaaaaagtggcagatgtttgaataatataatatacattaatagcagaatgtcagaaatagataaatatgaagttttagctgaagaactaggacattataaaactactcatggaaatatattgaatcaaaatagtgtaatcaatagaaaattagagaatgtagcacgacgtgaaggttttaatataattgtcgagccaaatgatgtagttgaagcaataaggaacaatgctttcgctatgcatgaaattgctgaatatgttcatgtatctgttgaaacatttttcgatatattagaaaattggaaaaaaaaatatggaactggaatacaagttggtacttgttatttacaatttgaaccttgcttttatttcataagagattacagtaataatggttcattaaattatagaacccttgaagcccctaataagcaatattctttacatttaaaaagaacatatgtactgaaaggaggtgataaatatcaaatttgagtctattgaaactgaagaaaaatacacagaactttattctaaattgagatatattcatataaattataaagataattgcataatatcaattaagatgcaaaaggttctaaagagtaattaacagattttaataaattaattaatgaatcggagttgatttgatgaatttagaatacaatattacctatagacaaaaagataaaggatggcaatttataatcagttataaattagataataaatggaagcaaaaaagtaaacagggctttagaactaaatctgacgccaaaccagcagcagaaaaaatgttaaaagaattaaaacatcaattaagaaataaaaattctattttagatactaattatgattctattacttttaaagaattatctaaactatatatagatcatatatctttatatagagaaaataacactatcaatgcttatcaatattcatttaataaatttaaaagtttaaatactttaaaagttaaagatataaaaaagttacacatccagaaaacagttgatgatatatttaaaagtgaaaaaatacaatctaaaactattaatacttatgttaatcggataaagttattattaaaatactatattgaaaactatgattcaagttatgaactatttaaaaatgttcagcttcccaatgacaaaattgaatcatcaaaaaaagcattaacgaaacaagaattagatgatttgcttatagaattgaaatctaggaagaatggtcgttattacattgcagcattaattgctggaacttgtgggttaagatgtggtgaaatattaggtttgacttggggagatatagattttaagaataatactttaaaagttaataaacaatggaaagttaataagaaaactaaaacacatgattttggtgcattaaaaagtaaaaaatcatacagaatagttccactacccgctcctactgtaaaagaattactagaatacagaaaagtcgctataccagacataaataatagaattattccttgtactggaggttcgatcaagaaatttttgaaccctattctaaatgatattgctggaatatcaattcatgagttaagacacacatatgcaactttattaattggtaatggtattgattttaagacagcagcacagctattaggtcatgatgttcaacaaaccttaaaaacctatagccatgttactgatgagatgttaaataaagctactgaaaaaatctcgaaaattttttaaaatttatttttgacgaaatttttgacgaatttatttttatttatcttaatgtttcctttgtcaagtaatgataaattagcttaactgtattttcaagtgctttataatgagttctttccataccatgagaagctgaaacccctggtcctataagagctccacgtatatcgtttccgcctctaagagctgctccaacatctgatccatagaatggatatatatcaactgcataatttaacttgttagcttctgctaaatttacaaggtcagttaccatattatagtcatatggccctccagaatccttagcgcatattgaaacgtcatattcactgcagcttaagtcatctccaatacatcccatgtcaacacttatcatttctgttatatctttcggtatagatgatgctccatgacctacttcctcatatgtagaaataattattttagttgtataatctggaattacattattctttttgaacatttcaagaatagttaatagacaagcgacacttcctttatcatcaataaatcttgattttacaaagccactttctgttattacaggtttaggatctataaacacaaaatctcccggtcttattccaagatcaattacatcttttttagacgatacaacttcatctattcttatttccatgttttctggatctctttttttgctctttgcatcttcaaatacatgggctgcaggactagtacttaaaaaagttccactataaatctttccttcacgagttcttatattgcagtattctccatcaagagttggaacaagggggcctcctaaaagtgtaaatttaagttttccgctttctgtaatagatcttatcatacatccaagagtatctacatgagctgataatcctatagtcttactattttctttaccttcaattgtaattattccacatcctttattgtttctttcaaatgaataaccaaatccactaacaattgtttctattttatcaattatttcaaagcaaaatcctgttggactattttcctgtaatatctcttttagcgtgttaagtagatattctttatttacattaatattcatacaatcaactcttttctcaattttttatttcataaaatttaatattcttatataatattaaattttaacatttccatataattatacaccattaatcatatttataaaattatataagaaaagctgattctatttaaaaaatcagctctcatatgttctcatcaaattaaatatataactaatatttatcttaattaggataataataaaaatgtgttgccctatcagttatagatgtgtcctgatatacttgtcttttgtgtaaaactttattatcaaaattataagattggttgtccacaatataagcatatccatcagtatcccagcacataaatatataaacatgactatagttatttgtaaatactatgtctcctggcttaagctgtgataaatcataacaaggaacaaaccccatatacttaagttcgttttcaagttcataagtattacatgtagatgttggtattccaactcctactcttcttaaagcttctgatgcaaaatatacacaattattgcttgtaattcctccatgaagagctacagcagttctatctacactaatttgatttcctaaatcagtcatatatttaaataactgatagtttgtattagaatgagaataatcataatatgtattaacagtctgtccattagcctgtatataagtatagttatctatccatacgttgctttttattgaacctgaaccatcagctgcaaaaatatattttttcccatttataactttttcagtatttgtagccattatacctgttgtttcatcaaaatagtactgttttccattaacattaactaatccatactgcattccaccactttcacagaaagaataattatatcctcctatgttttgaaatcctgtaagcatttctccactaggtgcaaaacaaaatttagttccttgtatattctgaagtcctgtaaccattattccatcagcattaaagtaataccattttgaatttattagtttccaatcattttttatcattcctgaaactctatcataatagtgccaaatattatcaacttgttcccatccttcttttatgaaaccttgttctccaaaatcataagttactttatctattgtctgaactccagtgagtctctcaccatatctatcaatatatgtccaatttccttttaataaatgccagcctttttcaagtcttaattgatttccttctacatcacaataagcataatctccatcaataattttcttttctaaagattctggcaatttccccaatttattatcacctaaatctaagtgtgtaagattagtcatatttgcaatttcttctggaatatcaccatacaatctgcaatagtttaaatctaaatactgcaaatttttaagaagtgcaatttcatcaggtattgtgtcatctatttttttatatctaaaatctattttaataatatgttcaaaatcttcagttgtaagatctttaaaatctttatttaattgtgatgctacctcttctgttaaccagttacgttttattttgtaatcagattgagttttttccttaatagaagtatcatttgctaataatttctcattttgcattgtctcttcataaacttctgttttttttatttcagcattagcatttgtggatataaaactcaaacctatagtaataattcccaatgccaataatctattttttttgtatgtcatttgatatcccccatttttcaacagtaataattataccatttattacattcaatctcaattaattagtaatttttccaaataaaaaattaatcctacaatatataattaaaataattgtaggattaactgatattttcatatattttaatattttaatatttttttacatttgcaataagtaaactcatttcttcatctgttcctattgtaattctaagataatcttctattctttctttattaaaatgtcttacaagaactccattttcttttagcttttcatataaatactttccactaaattctttatgttttacaaaaataaaattagcttttgaatccaaaatttcaaaattaagattttctaatttttttaccgtatcttctcttgttcttattatttttttagtagttacatcaaaataatttttatctttgatagcttctgctgcaccaatcagtgcaagtctatcaattgtatatgaattaaaactatttttaactctatttaatccttcaatcagttgactattaccaattgcaaatcccactctaagtcctgcaagagatcttgatttagaaaaagtttgtataacaaggagattagggtatgtttctatatactcaaccattgatttgccaccaaagtcaatatatgcttcgtctacaataacaactgaatttttatttttttctaaaacctctataattttattagtctcaatatattttccagttggtgcattaggattaggaaatataattcctccattgtctttataaaatccttcaagtggaatattaaatttatcatcaagctttatatgttcataattcacattgaacatttcagcatatacattataaaatgtgtagcttatatctggaaataaaacttttctgtctttttgaaaaaaagtcataaatacaaatgcaagtatttcatctgatccattccctatgaatatttcatcatcatttatatgatagtattttgctatttccatacttaaattactacatgtaggatcaggatataatttcaaatcatcacaaactgcattttttatagcatctataaccttaggcgatggtccataaggattttcattagtgtttaacttaatatattttttatcttttggctgttcccctggaacataaggttctaatgtctttacatggtcattccaatatatgctcattgctctacccccaatattttttatttaatttaaaatataacattaaaatcccaaaaattaattttagggatttttaattgattattatttatataaacgattaatagcactcatcatagatttaattgaagctcttgtaatattactatctgttcctacaccaaaagtcttctttttattatctaatctttccatatatacatatgaagcagcttttgcttctgatcctgtactcatagcatgttcagtataatctataattttaacattaattaaactactttctgctaaagcttttttaaatgagtctataggaccattacctataccttctagaactctttgctcaccattataaacgacaattacatcagctttagtatcttcacttccatccatttctgaaatatcagtgaatgtacattttaacaatttaaaaggaacatctaaatctaaatattctttagtaaatgcatccataacctctgatggagatatttcccctttaacttctgacatcttctgaattatatctgcaaattccttctgcatagtttttggaagtttaaatccatagcaatgatccattacaaatgcaactccacctttacctgattgagaatttattcttactaaagcttcatattctcttcccaaatcgctaggatctattggtagataaggcacttcccatatgtttccatggcgttcattgtattttttcatacctttattaatagcatcttgatgtgatcctgaaaatgcagtaaacacaagatttcccgcatatggatgtctcacgtgtacaggtattttcacacatctttcatatacttctattatttcatttatgttttcaatatcaagctgcggattaactccatgggaaaacatgttataagcaatgtttaaaacatcaacattaccagttctttcaccattaccaaacaatgtaccttcaattctatctgctccggcaagtagtgcaagttcactgtctgcaactcctgttcctctgtcattatgaggatgtacacttaatataactctctctctatctttgaagtttctgcacatccattcaatttgatctgcaaaaacatttggagtatccatttcaactgtagctggcaagtttataataactttattatctttagaagcttcccatgtgtccattacagcttcacagacatcaagagcataatctacttcagttcctgtaaaactttctggtgaatattcaagaagaatttctccttcaaaatcttttgcatattcttttacaagctttgttccctcgacagcaatttcttttatttcttccttgctcatattaaatactacatctctttgcaacactgaagttgaattatatatatgaacaattgctttttttacatttcttaaactttcaaaagtccttttaattaggtgtggtcttgcttgtgttaaaacttgaaccataacatcatcaggaataagattttcatctacaagtcttcttaaaaaatcatattctatttgtgatgctgaaggaaatccaatttcaatctccttaaatccaagtttaactaataaattaaaaaattcaattttttcttcaacagtcattggatttataagtgcctgattaccatctcttaaatcaacgctacaccaaattggagcctttgttatctcattatcaggccatgttctatcctttaattttattgtttcaaatcttttatattttttataatttaacatctatagtgccccccaatatatttattataaatttaattctaatgtccacattcatttttatattctcagatatagcccctcaactacacctcttatcttcataataaatataattactttatctactttcttgttaaccccaccaaaatcacctctttgtaatttttagaacattaaatgtattttaccacaatattgattacatgtaaatatttcgaggtatttctatgcattttattaaaaaatacaaatattttttaaacatttattaatcatcacaatcttcaaactttctttatttacttaattaataaatttagaacatttaaatacttgattgtatatattgtaataaagctatttttaggagcagattatgaattttttatcagcattattattaagtacagccattaatatagacacattaaaaatttcattttcttcaaaaaacgatagttcagtgccgctaaatttaaaaatactttttgcttctatttttacgacctttattacttttcttgctttttgctttggaaaaataatagatatatactttacacatagcttaagtaatatttttggttcagttcttcttggatttgtaggtgtttattatcttattgaacatataaggatacaaaaagataatgatggatatgatacttcattttatgtgaataacttcaaaaaacacaaaaatcttattgagttaaataatccatatatttattctgattcttttaaaaatctttttaatatttctattgcactaagtcttaataatatattgccatctattgctggaagtctcactaatataaatcttcctttaacaattttatttaattttctaatctgtatattcttttatattgctggtaactttatttataataaaaagtttataaaatatataaagactaatcattatctaattacaagcattttacttattatattgtcggtatttgaaagtttccattaatttagatatttttcgcaggcgcaaccgtgcctgctttttaaatatttttcttaaaattcaataatatttattgaataacttctaaaatttatttataatctagtaagtatttaattataaaaattaagttattaatactattttcaagggggaaaataaattgaataattacaaaggtataatttatgctattttatcttcaatagcatttggtattatgcctatttttgcgaaaatagcttacaaaaatgggtctaatccaacttcatcgcttctttttagatttcttatttctggtttaatactactactatatttaaattttaaaaaagttagtattaagatttcagtcaagcaatttttgcttctgtttttcattggaatgtttggatatactataacaacaataacgttatttgtatcatacaattaccttgattcaggtcttgctactgctctacactatatttatcctgcactagtttgtatatttagtttcattttatataaagaaaatataacaaaagaaaaaattttttcactagtattatcaataattggtgtttattctctaattgcatttgaaagtaaaactcttaatattttaggtattcttttagcgcttttttctggattagcatatgctctaaacgttatttctttaagttttaaatctataaaatccatagataatagagttgtaactatgtatatatgttttggtgcatctttatgaatgataatatatggagcttttactgaatctttaacttttacaattaatttagaaatgatgatttcctatcttggtctttcaattatttctactattgcatcaatgctatttcttctaaaagctattaaactcattggctcaacttcagcttctattttagccacttttgaagctgtggtcagtatcataatgggaataatattcttaaatgaaaaattaacttttgctttaattttaggaacttcacttattataatctcaacaaccattttagcaagagaaaaatcccctaaaccttgtgatcaatacaataaactatctaatgctatagacattaatcactaaataagaatgagatatccaaattaggtatctcattcttattttatttaatctttatctatattcaatatttcaagactatctgcatttattgatatgttacttccaagaggaatgctcattgttggaagagtatgtccacatgcaatattcataattgtaggcctcttttcaggtattattatttcattaaatacttcattaagactcaaacttctacttgtatctttagcatcacaacctgtccacgaacctaaaataataccagctgcatccttaaatttatttgctagcctaagctgagtaagcatcctatcaattttgtatggtgattcatcaatatcttctaaaaataatattttatttttagtattaatttcatatggtgttcccataagtgatgctataatagataaattccccccagtaatccgtccacatgcatttcctttaactaaaccttcaaaactcttgcacttatcaggattaactactttttttgtataatttattttaaatatactatctttaaatgattccactgtataatcatctatatctgtataaaattcagtacatggcataggagtatgaaatgttatcattttacacttttgatttattgctatatgtagtgcagtaacatcactatatcccgctagtatcttaggattcttttttatattatcataatcaatcatattgagtattctggctgctccatatccacctcttacaataaatattcccttaatatctttattgtggaacatatagttaagatcatctgctcgtaccttatcttctccacacaaatatccatgattttcatttacacttcttccaataaccacttcaagccctagtgatttaatccattttatagcaggatctattctttcctttttaggaggactgcatgtacctattattcctattgtatcacctttttttaatggttttggtctaatcataaaaatccactcctaacaaacaatatttgaaagcttactattttatatattattaataacatagcaaaaaatattcagttagttacaaattttataagtaactgaatattttcagactacaaaaatataattatagtttaggaattcatgaatatatcaagaagataaccagcctcatcaagagatatttttttagactgtgctatttcatctattagaattctttttgtatttcttaagatagttttttccatggaatttaaatcatgaattgtctttaattctgtcaagttacttattatctctaaaagatcttctaatgtacctgacttaactttagtcgaatatatttcatttctttctttataattggttttagcaagtttatcaacctctttaacatagtattttatattatttaatttagagtctaaagtttttgaatcacttatatgtctcatattagctgattttactctactaagcgggagtgataacttcattgtattattaattaaatgaattttataatatttttcctttttgcctttaaattctttttcctcgatgagatctataacccctacaccctgattaggatacactactttatcaccaatattaaattcaaacaaacttacacctctttttcttttttatatttttaaaattagagtaattaaaataactgattattttaaagctttacaataatcaataattaaattcttcttatttataaattttgtacaatttttattaaaatattcattatctagatgacatatttttattaaaacattttataaattattatttttttaatttctatattttttgaatattttataaaaatacggcaataattataaaaaaatatgcttggagatgtttaattttgaaaaaatattattatctatttttatttacagcacttatttcaatattacttttatcatgccaattcataccttcacttaaaagtaataagtcaataagtcctaacaataattcatttgatatacattcaaatgatgcaaatcaaaatagtgattcaaacaataattatgaaaactctaataacaacagtgatgattttgtaattccatgctcaaatgcggttcatataacaatacgtgaatttataaacaaccaacaatgctctagctatttagtgaaagaaaacgaaactcttaacgatattttaatgaggtataattcaacatgtgctcctaatgcatccttaaagcttataaaggaacttaataatattacatctactaatgatgtgaaagctggaactactttaaaaattccagaaacaacaatgaaaaatggaagtatatatacgatttcgcaaggagatacatggagtaaaatatgcgaaaaatattatccagtatacgatatagattctattatgaagcttttaatttttattaatgattataaaaatgacattcttccattaggtgatactatattccttcctaaaatataataaaaaacagcctgcatattttacaggctgtttcttaatgatagaaaaaattctaatttaaaattagttattatttttagtgtcctcactataacatataataggtgtgtttgattcaatattttcaaatattatctttgcaagatattgaggcatatttacacaaccatgagttccattagtcttatatatatttcctccaaaagaacttctccaccttgcatcgtgtaaaccaatattaccattaaagggcatccaataagaaacttttgaactatatccatcaccttttaacgttgcatccttctgtttgtagttcagagcatatacaccttcagctgtaggtgtatttttactttgacatccagttacaatatcccctgtgttaaaagctttccatttttataaaaccataaatgctgtcttgttatattgacttcaacatacgtatccccaatatcatcatcactccttgataatcccttctgagaatatataggctctttaaaaacagattgcccatgttttatattttcaataagtgctttaacctcttcattagaattaattttccatccataatatcctccctttacaataacagtttttccaatgctactatcaaacttacgttctttacctactgtattgtatttttcacataaactatctatatattctttaacttttttttcatttatagatggattcatatcatcatctatatcaatccatttattaattattgatccatctactgtttccataagttcatcaaaagaatatactatctttgaataaacatacttatcaataatatcttttacttcttttactttttctgaatcctttgtatacttaggtctttcataacatccagtagtatttaaatccacaactttattaccatgctcaattgcactttttatagccttaactgttttttcataatttagtttatttccttttacctcttctaacacaatatattttccatcagtatattggaattgaggatttttaggttcaattacatctaaatttttaaaaaaatttagatctttcactttttcctcaagcattgattcatcatatgtaaaaatatccaaattctcatattgcttattgtaaattaatgctgaggcccatttaaaaaaactttgcttttcctttatttcttctatttttttatctccgttatactctagattaatatcttttgattcaattttatcttcattgctatcgtcttttattacaactttaaaatcagaaagttcattatatactatatcttttgcttcatctactgtcttaaatgatatatcaataccatttactgatgttttgaaaaagaaatgagttttaaaataaaatgctcctaagaaatatattaaaaatagaacaattaacaaaatgcagcttatttttgtactcttctcatacataaattccttcatttaattattacatcctttctttgtttgaaagaaagtaattttaatgctatgcttataaaataaaacttctttcaatcttatattgaatatgttataattccaaatcttatctccattaatataattatgttattcataatgaatttaagacatttatttttaattcttaaaattaagttttatttttaacaaaagctaaatagaatcatgattattatgttaaaaactatatcttcataaaactgactgaaattacaaatataaatcaatgttaagttactaaatatatttaaaaattcactttatttttaaaataaaaaataaacctaagaataagttgaatgatacttattcttaggttttaatttataaattactgattataacatactttttccatcattatagatacattttttataatatgtttattataaagtttttactcacatactccatctggtccaagtttatatccatcaatagtggcatttgttaccatagctccatattcatttagataataccatgaattattactataaacccatcctctttgcattattccatcttcatttagataataccacaaaccgccatcttttatccaacctttatgcatgttaccccactggcctacataataccatgacccttcattttttatccatccagttgccatttttccatcatctttaagatagtaccattttccccctactttacaccacgatgatttcacaatgtcacctaaaccatcataaagataatagcttccatctgaattttgtacccaacctacattatatctgatattttcttcggtctctttggaagaattaatttcagaattcttttcaatactacttgtattagcttgtccttttgtattgcttacattatcatcagccaaagctgtaactggagctaatgttattagtgtactcaaaaaaagagctatatttttattatttctttttatcataatatccccttaacacacaaaaaaatttagttatatttatagaaattaaccaaatttaaactcaaaaatacaaatcttattttctatcatattaataattatatcaaatttatccagtttcttaaagaaatatttattatcttttacaactctctattaaatcttgaataaaatattgctctacttacataaaatatatattatcgcataaagatatgtaagaattttattttattataaaaaatacattataaactacagcttactataaaagaaatcttagttcaatttgattaaatataacttatattatggaggtttatatatgaatagtaaatatactgatttatttcatgaacttattcaagcatactatgatggtaattttgatgaaactctttcacgtattatggtatgtcatgaatcatcacctcaggaaacttttaaaatcataacatcactttgtggcgtaaatattgaatttgataataattatatttataatctaaaaaaagcaataacaatgtactctgtgaataagcgtattgttgagaaacttgaatgttctggagtaaattgtataaagagcaaggacgataaatttacatgtgaagcagcctgtccttttaatgcaataaaatatgatactactaataaaaccacatacataagcaaagatatctgcattaactgtggtatatgtgttgacagttgtaaaggtggaagaatcttagataaagttgagtttatacctgtaatgaatttgataaaagaaaataagacagtaatagcagcagtagcaccagccattaatggtcaatttggagataatgttacaatggatatgcttagagaagcatttattaaaattggattttctgacatgattgaagttgcctttgcagcagatatattatctataaaagaagcatgtgaatttgataaacatgtaaataaagatggagaccttatgataacatcctgctgctgccctatgtgggttggcatgttaaaaaaagtatatacttcattagtaaaagatctgtcaccctctatttcaccaatgattgcagctggacgtataataaaaaaaataaatcctgatgcaaaagttgtctttataggtccttgcattgcaaaaaaagctgaagctaaggaaaatgatttaaaagatgtcatagattttgttttaacctttgctgaacttgatgaaatttttaaagcgttaaaaatagatttatcatctttaaagggaattccatcaaaagattatacttcaagaggtggtaggatgtatgctagaagtggtggtgtatcaactgctgtttcagacattatagaggaactttatcctgataaattcaagtcttttaaatcaagtactgcttcaggtgttaaagaatgtaaagaaattcttgaaaaggcactaaataaagaacttgattcaaatttcattgaaggaatgggatgcaaaggtggttgcgttggtggtccaaaaacccttatacctcttgaaaaaggaaaacaacaagttgataattttgcatttgattctccaataaaagtaccattacacagcgaatctcttgataatatcttaaaagaaattggaatcaattcaattgatgattttaaagataaacaaaaaatgtcattatttgagcgtgattttaattcaaataatgtaaaaaaataagttaaactaaaaacaacttcaacctatataattctttaactaaataataggttgaagttgtttctatatttaaattttttcaactttttcttttggctgttttttaggaagtattattgtaaatttgcttcctacatttatttcactctctgcaaatatccttccattatgtaatcctacaataagttttgttattgtaagacctagtccacttccaccttttgtttctttattcgagtcaattacttgattaaatctatcaaatacagtttcaagatgtttttcatctatacctattccagtatcacttaccataatcttaacttcattttcaagttcaacaacagatactaatatacgtccaccttcatctgtaaatttagcagcattattaacaagatttattatacatctctctatttcattagaatcacattcaatgaaacattcttctacatctggatcgattattaattctatatttttactttcaacataatctttaagtgatagtgctgtatcctctacaatataaacaatattatgcttgcctatatttatatgataattcccatgttctatctttgatgaatctatcaagtcatttatcaatttaagaagtctatcaacgttcttaccaaatatgttcatgtaataatcaagtttttctctttcaatacctgattcacttttatttaattggtttataagttgatgaatagacgataaaacatttaatggagttcttaaatcatgagatatgtttactaagtatgcattttttcttttttctagatttatgatcttatttagtaattctgtatttttttccatttcatcacttaattctctagttctcttacttaccatatcatctagcaatctcatcttagtatttttacttttaactattaatactactaaacttacacctatcaagatatatattaatataaattcagcacttctccaaaatggaggttttatagtaaatttgaaactactttcttcactaaaaatcccactgctatttcttgctttcaccctaaaaatgtaagtgccacttccaagattacttaagacaagttcattggtattaactagagaccaatcattaccggctccttctaatgaataataatattgtgtattttttatatttttataatcaggtagaaaaaatttaatcccaattgtattttcattataattcaacttagcatcttgtaatgtatctatagttctaccatttactctaaatctatcaaattcaactctaggtatatacatattattcaatatttcatctggatcaaatatatttaatccatttataccaccaaaaattaattctccactttttaatttcccataagaatgaccgttgaattcgttactctgtaaaccatcagttatatttaaattaaaaaatctatctttttctctatctaattttgaaataccaagatttgtactcatccataagtttccagatccatcagttacaataccatatatattattattagcaagtccatcacttgttgtatacgtcttaaacttaccagtttctttatctaatttattaagtcctccacttgtaccaacccatatatttttctcatcatcttcaataattgttcttacagtattgttagataaatcaccatcttttccttcatacttgtattgaatagcagtattattgtatggatctatttttattaatccaccatttaagaaactaccaagccaatagaatccttcgctatctttgaaaatacattctgaatatctatcatctaatgagtatttatccaaaatataatttaaatctgtgattttatcagtttctaaattcaatatattgattccatttgttgtaccaatccataatacaccagaatcatcatatgttatattccttatcttttttgcattaagcccctgcttttcattatacactgagatttttcttgtatttttgtcatatatatttaaaccattgtttgttgcaataaagattttatttgcatgtccactaatatcatttattgaattactgcttaatgcagttccatttgtaaactctgatatatcatatatattttcattttttctatctaatatatttactccttttgtatttgtaccaatccatattagtccatcatcatcttcatatataccatgtataagattttcattgatacttgaatgtgataatggatctactttatagtgttctatcttattttcaggttcaaacatacttactccagcataggttcctacccatataagcccacttctatcttgtatcactgagtaaacataatcgtcaactaaagaatatttatcgtaagctttattaacataggtattatactcatcatttttagaatcatattttactaatccagaatccgtcccaatccacattattccatttttatctttcataatagtatgtatgttattgcttgaaatcttgctattacttatattaatggtttctatttcggaagtttcaatgttaattttatacaaaccattacttactgttccaacccatatatatttatcatcacataaaactttataagcacagtcattaattttttcatactctttatttatatcagaaaaatcctcacaagtattattttttaagtttatctttgtaagattctttgagctaccaagccatatatctccattaatatcttcatctaaggaataaatttcttgatctttaagatactcattattgaatattcttgtaaatctatcattagtcttatcatatatattcagtccatcaattgtagctaatagaatttctccatctttagtaacaagtatttcagttatattattgttagataatccacttgaatttttataatttgttatctcgttggtagacaaattaattttacttgctccatctatggtcccaatccacaagtttccatccctgtcttcattcatacatacaatatagttatttacaatactattgtctacaccaatttcgtttctatatacttcaaattcatgcccattgtatctgcttaatccatcattggttccaaaccacatatatcccctgctgtcttgaatcatacattcaacagttgcctgtgcaagcccgtcttcaatggttatatttttaaagactatgttgctatacgcctcagcttttactacactaatacttgtaaacagatttaaaataaaaaaaataactgatatttttaaaatggtatttttcaatttattaatgattatcacttccttttcttatatcataatctgaatctcttatgattttctgactaaacttaagtatactgactgtcactaaaaatatgtaatattactaatattaattttttattaacaaatataataatatcataccattctacatttttccacaaattttgtatattctcttttttataaattacactttgttattgatatttttctcttaaatttaaattatttttataatgcaaattatagtaatatttcaaatatcaaatatcccctgcaatatagaaatttacctaatctatattacaagggatattataaaatcttctatttactgttttaatgatacactttctatcacatcttttaccttaggaacaacataatgacttccgcctcttccttttacatcttcaatcatcattgttacaagaaccttattatcgccttctgttgtcatacctacaaaccatccaagctcagttccactggtatcagtctgactatttttaatttctgctgttcctgtttttcctgcaatttttaattttgaattatatgcttcatgtcctgttcctgcaggattttctactatctgtataagatcattaagtactatctgtgcactttcttttgagactacactttttttccatatgatattattatttttattatctataaccaaatgaggttcaatgatatttccttgattaagaaacatactatacattgatgttaaatgaacaggatttaccattacttctccctgcccataacctgtatctgcaagttgagcaccttcttttatttttccatcgtttgaatattgtgaattatatagtgcaaattcaaatggtattttttctccaaatccaaaactttttagtttttcctctataagattgctccccatatccatagcaatttgtgcaaagtaaatattatctgaataaaccagtgcactttccaaatttacttcttctatattgcttgtcctagttacataataatttccaaagctttcatctttttgccatgctaacccactaatcttccttacttgatctggctttacgctgccactatcaaccccaatagccgctataattggctttaatgctgatcctggtactgatgtagcctgaaatctattaaacaatggtttatcttcattattgtttaaagtgttccacttttcttgtgacattcccaaaataaaatcattaggatcatatgatggtgtacttgatagtgctaatacttcaccattttctggattcattacaacagcacatcccttatcacttccaagttcctcatttacttttttttgaacattaatatctattgttaattttaaatcctcaccatttctggcatctttagataataccacactctttttttcaccttcactattttgaatatatatttcagcaccatctatacctctcaaaaaatcttcatacattttttcaaggcctgcttttcctataagtgaattttcagtatagtctttatctttattttgttccaattcatcaccattaatagattgtacatatccagttatatgcgctgtatctcttcctaaaggataaactctagaatctttttcttttatcattacacctggtacttttaataaatcaactacttttgcatctccatatggtatatctttaattggcacaaacatatcatcagtaatataattggcacttagtgctttatttatagtttcagtactacattgaagtatgtttgcaatcttagttatactttcttctttattatctcctaatttccctggaactactcctacatttgataaatatgaatctgtagcaataagttgtccatttctatcagtaatatttccacgtcgtccttttaatgtttttacacgcaccttatcattttcacccaaatcaggaaaaatatttttagaagtccattttattgtatggccttttccaagttcacttgcaatttttacactattgtcaaattcaagttcacctgctattgtatccattttagtattgtaatttatcaatgtatcgttatcttcttttgaaatagatttaattgttatatttatatctttagcttcaattccctcataaatatttttatttcttgcaacaaaatcttccctgcttatttttgcctgagcagtactgtcgattaaatcatacattttatcatattctttattttgaagaagttcagtatattcctgccatttattttcaggtttatgagtgtagctgtaccccatatatattattgtacaaatcacaagtggaactactactatcaaaactccaacaagcatatatagattcttttttttctccatataatatcacctcataatatagtacttacaatatttacatttaattatataactatataaaataaataagctattaaaataggaataacctttcattttaatagcttaattcaaaactaaacagaccaaataaaatttatacactccataaatattcatattaatgtttaggcgacatgtgtacctttttaatagcttttgtgacttcaacaactatattcgcttcactttgctgttccatgttttttattttagttataacttcacctaaatgagtagttacataatatggttttaaattatttaaggctattgccatcatatcatatctgcacttttcgcatttacatccattactctcttctataagcttatctaagcattctttgacgcttatctccatacaattggtaatttttttcattgatctttctcctaacataaatatccagcccaatataaaacttaacttttttccttatatacttactaataatttcaccaaattatagtattattataatataagtccaactatttttacatagtttatatctaaatattattaaaatgtaatatttagatattcatacttaatttatcttctgccaattctaaaagcttttttttataattaagattattatcttcaataaccttacaaagaagataattcagcattgttccaacatctttacctttctttactcctattttaattatatcttcaccattaatcttcatatcccttatacgaaaacattcgtttttttcaagaatgtcacaataaagcttttcaatattcaaaaacttaacttcttcaatgttttcagacattatgtgagcctttttaactttaataagatcttcgaataattctacatctattatattaagtaatttttttattgaaactttatcttctaaatcactatgcatatatgttatcaacgtctttactttcttaattgttccattatcatatttcaaagaccttaatattttttctgctatacaagcactttctataaaaatattatctactttttctaacttgttattccaatcctttaattttcctaagtcatgaaaaagcattgtgagccttaaggataaatccttttttatattgcacgatgataaaattaaatgttcatataaattataacatttaattttatcatttatatagtaatcataggccttatctaagtcatcagcaatatatttcagaatactacattcatgtaataattttaaaccatttggatctttaagaattattttattaaattcttctctgattctttcttttgatataaattctagattattattaagaattttaattgactgtataatagattcttcaattttaaaatcaagttgtacagcaaaccttactgccctaagcattcttagtgaatcctcagtaaatcgtttttcaggatttccaacagttcgtattactttattctttaaatcagacaatccatcaaaataatcaattagtcccttttctttattatatgccattgcatttatagtaaaatctctcctagataaatccttctttatattagtaacaaattttacattttcaggatgcctgctatctttatactctccatcctctcgatacgttgtaacctcatattgcaccttattaattacaactgtcacagttccatgctttaatccagttaaaataactttatcaaaaagacgtgcaacaacttctggctttgcatttgttgtaatatcataatcatttggttccctatttataagaagatctctaacgcagcctccaaccatatatccttcatatccattttcaatcaaaacattaattatatattgaacatcagatggtattttcaacttataattcatattgtcacctctttcatcttcacagttaaaaaggttctaaagctgccataatctagcatcctttaaaacctttttctactcatatttaattaatcatctgctacatttttattatttattgaatacacgttatagttcttccatataagctcaagatttgaaaatacattagagatattttctttttctctcattccaacagctattattaaagcattaataacagaaagaggtgcaacaagtgaatcaacaaatgatgccatattactttgtgctattaatgtataatccgcttttgttgcaagtggagaaagaagactgtcagtaagggcaacaaccttcgcacctctatcttgagaaaattccaaagcatctattgtttttgctgcataccttggaaatccaattccaataacaagatccccttctccaacatttatcatctgttcaaaaacatctgaaattccataacttaccactttaacattttgaagaattatatttaaataaaaacctaaaaattctgctagtgctgttgaacttcttaatcctattatatatattctttttgcttcaaaaatatgttgtacaacatcttgaaatgtattttgattaattttctccaatgtggctcttatattttccatgtctgcttttaaaacacctttaagtgcatctccatctgaaaaataatcatttcgtagttcaagcctttgaactgttgtaagtttattttttataagttcctgaagagccttttgaagtttcggataacctgaaaaaccaacttctatagcaaatcttaccacagtggattcagataccccaactgcattaccaagttttgctgctgtcataaaggctgctttatcataattttttagtatgtactctgcaatgagcttttgacctttactaagtcttataaactttccttgtattagtctcattaaatctttgctgttttcattatttaattcttccataatttgccttcctaataatcaattgaatacttttaatttaattctatcattataatccataatattcaataaaataagttatttttcgcttttttattaatcatatgcaagtttttatataatcactttcaattactgtaaaattgactttaagatttaattatttttttatagtgacattaaatatttcatttcctcatcatttaaatatctatattcacctttctttaactgaccaagcctaatatttcctatagatactctttttaatgacatgacctcatgatttattgcagaacacatttttctgatttgtctattttttccttcatgaatacacacctcaattgtcgataaatctttcctatgactatattcaagcattttaagttttgcaggtgcagttatataacctccaatatcaattccactttcaaacttttctttatcatcaagtgatacttcaccttttacaactgctacatattttttatcaagttctactcttggatgaattatcttattgtataattctccatcattagtaagaagtataagcccactactgtcataatccaatcttcctattggaaaaattctttcattaacttttactatatcaattacagttttcctatctttttcatctttaacagatgttattacatcttcaggtttatttagcattatataaacctttctttcttccttagttataacccttccatcatattcaactatatcttccaaaggatttactttaaatcccaattcttctattatattaccatttacttttacttttccaagaagaataagttcctcacattttcttcttgatgcaattccgcacgatgccatatatttttgtaatctttcttccattgttttctccttatactttcctttttttattatttatttaatacctatatatttattctaatttcattatattactatattttattttatcaattattcatgaaaaaaagtgcctctgattaataaaaaatcaatcagaggtgtcttcataatcatataagccataaaattttagtgattctttctccatattgaaggactgaacataattaacattggatatatttcaagccttcctgcaagcatacagaaagaaagtactaatttactaagtggtgaaaaagcctcaaaattccctgctggccctacaacttcaagacctggacctatattactcatagttgttattactgatgttacagttgtaacaacatcaaaattgtcaaaagatattataaaaatagctataagacttattattatgtacgcaccaataaataaaaacactccatgtattatgtcttcatctacagtttttccatctatttttacactgtttactctctttggatgtattatcttattaatctctcttttaatagctttaagcattattacaattcttacagtcttaattccgcctcctgttgatcctgccatagctcccacaaacataagcattactattattagtttacttaaagtaggccagaaattaaaatctactgtagcaaatccagtagatgttactatagatgagacttgaaaagcagactgccttactgaaagtataatatctccaccatttaaacttattatatttactgttattaatataaatgcacttaaaataattaataaataataccttaattcctcattcttaaaaaatcctttaaaattaccttttaagatctgaaaatataatgcaaaattaataccaaatataagcataaatattgttattatccattctattgcaggactattaaatgcagcaatacttgcattcatatttgaaaatccaccggtacctgctgttcccattgcatgtataacagcatcatataaattcatccctgcacacatcagaagaattccttcaattaaagttagtgcaaaatatattaaatataatatctttgctgtttcttttattttaggaactattttacctggtgatggtcctggactttcagctttaagaagatggattgaattacttccaagagatggaataagcgcaagcataaaaataagaaatcccattcctcctatccagtgagtaaaacttctccagaacaatataccttttggaagcccctctatagctgttaatattgttgctccagttgttgtaaaacctgaaactgtttcaaaaaatgcatctataaaactaggtattgcaccacttatcacaaatggaagtgcaccaatagcagatattattatccatgcaaatccaacaataagaaatccttcttttgcataaatagctttcttttctgctttgatattacttaatatgaaacctattggtgctcctataagaatagttaacaaaaatgattttgcatcaccttcaccataatataaagctattaataatggtacaaataaaagtgcaaccatatatttgactacattgccaagaatactcagtactgctttataattcattattcttgcctcctccgacaaatataccgctaaggcttaaaagatttgtatcctttgttacaacaacaactctatctcctggttttaaaatatcatctccactaggtatgattgttttgttttcacgtacaattgttgcaattaagctatcatacttaaagttaagatttttaattttaatatttatgtattgtgcattttcttttacaataaactctattgcttctgctttttcattacatattttatatacattttcgattggacatttctttctatttttaagagttctaacatacttgattattttatttgcagtaactgacttaggattaattgttgagttaattcctattgtctttgcaatttcattataattatctcttgttactttagtaattatatttttaacaccatttttagccgcaaataaagaagctataagattatcttcatctcttcctgttaaagtaatgaaactgtctgcttcttctagactttcagataaaagaagctcctgatcaaggccatctccatttattattactgaattaggaatcagttcagcaagttcttcacatttattaaaatcattttctattaatttgcaatgtacacctgcttcactaacaatcttagtaagatagtatccaattctacctccaccgattatcatagaacttctaacttttcttctatactttccgaatttcttgaaaatttcctgtatatctttatgttctccaataacatatacatgatcatccttttcaaagatataatctcctttaggaacaatcatttcaccatttctttcgattccacaaaaaagtacattacctcttagataaccaagttctgaaattttcttattttcaagtccagtatcttcagttatatcaaaacccaccatatttactctgccattagcaaaattatcaatgctacatacagatggatattttattaattttgatatttctcctgctgctgctttttcagggtttattacaagatcaatacctacagcttctgtaagaagtgtaatatcctcatcatatccaggatttctaactcttgcaacagtatgctttgcaccaagttttttccctgctagtgaacaaagcatattaagttcatcactatttgttacagaaattaaaagatcagcttcttctattccagcttcattaagcaccttcaaacttgtacaattaccttttacgcacattacatctaaattattatttattcgctctaaagcagtcattttattatctataatagttacattatcatttcctgtagaaagatttttcgctattgcataacctactttacctgcaccaactataataatattcatcatgttttctcctcgtgttttaaccttaacttaaatttcaaatacaattatacattaagtactccattaactcaaagatattatttactttttcaactttattttacgtatttttttaaaatataatcatttttttaatttaacatctataaattaaatgaagaaattcataatataatggttttagtcttcaaatttactttctatatactttaagtagaacttatacaacctaatgcatagtatataaaaagtaatatttttagggtatgaaatgagatacatcttagatataaaagaatgtgaatttttaggcaaaggccatgaaggttctgtttatttaactcctgaaggctatgcgcttaaaatcttcctcaaaaagaaaaaagctaaagaagaagtatcaatattagagctggttaaaacaagtaaattttttcctaaagtaatttttatcgctggcaatatgattcttagagaatatgttgatggcgttacattatttgaacatttgaaaaaaaatggtatttcttataaactttcttgtgaaataatcgatcttatagaagattttaagaaaatgaaattcaaaagattaaatatcagaaatgcacatattttcgtagataaaaatgaaaatataaaagtgattgacccaagaaaaatctttactaaaaatacaccttatcccaaagacattataaaaattcttgttcatttaaatatatttgatgattttttaaaaaatgttgctcagtatagatctgatcttcttcagtattatgtagatgcatacaattactatgtatatatgtctaaaaaaagcatgcacattgatatgcatgctgaaatatgctagtactttaaacagagctgttcttttagaactgctctgtttaaaattatatatataacttatttaaaaattcaattcctgctgcggtcttaaaatatttatcttttattactgaaatactacttttgtttattttatcttcaaaaatattaacaagaaaatcagcttctactaatatttgataatcaatattatctatacttccatatgtatgatgatgaccaattaagaagcatactctttctattacatcttcatcttcattaagtttttcaagcatagtccttgctacttgcggtccttctaattcttgataattacctgcagatgagttatatttttcttcacttatttttatacctatatcatgcattatagctgctacttctaatacatactgagtatttttatcaagtgcttctaattcaccaattgattttgcaaaggaatataccttcaaaaaatgatttattcttttaacatcctttgcataataattaatcatttcttttactattatgcttgtatcacatttcattttaataacaccccaatctgctatttatcatttcctttaaaagaaaatggaatgaatatgaggaaatgcaatcatattcattccatttttataactactaattatttttaaatgtagttatattaattatttcgttttggaatgcttttaataatgctttttctaaaactttttcagtatcaaagtttgcaacatctttacattctgcaaaaactttatttaatgcgccattagcattagtataagttaatgttacatatggtttttcaaacttaacatcaactatttttaatccccatgctatttgagcataatcaccatcaacagtaaggtgagtaagttttttaaacttttcagtttctttgtttggatctgttacaacgattaattcttctcctactttatactttgacataatatccctccattaacattctaaacgatgtatatcatatttattatgatatattaataatttaacacaaaggtacatttttatccatatgatttaatatatatgtaatatttttattttctaataattcatacttattactcatatttcgatttttaatataaaaaataaacctgaatattcaaaataaaacattcaggtttataaaggaagttacactacatattattttttaaataatctaagtatatatttcacaatttcatttactactacaatacttgctcctactataaatatcttactccaaagaataaaatctaaatgaacagaattaaagaaatctctaaatatttccacacacataatttgtccaattccagttaatataataacctttatagcaagtgtatttttcatgaaatttggaaaaatactgtctgttccaaattctctactattaaatgcattaaacagcacgctaaaagcaaaagtgcagaacataacagttgtcatttgttcattagaagctccaagaatattatagttctgctgaacaagtaacacacctgtaatatatagagcatttagtactattgttgtaatcatctgcttagttataatacttgcatttctatttactggttttctttttaatacatgtcttcttacaggctctaatccaagtacaagcgctggaggaccatccattattatattaacccataaaagttgtattgttgtaaacggcatttctttcccagtaatctgagataatattgcaattaaaaatgctattatattgacagtaagctgaaattgtatgaacctttggaaattatcataaattcctcttccccattgtattccttttactattgttgaaaaactatcatcagttaaaattatatctgctgcacttttagatacttctgttcctgaaatccccatagctataccaacatctgcttttgataaagctggagcatcatttataccatctcctgtaacagcaacaacttcaccattattttggagtgcattaactattctcatttttgtatcaggctttgaacgtgcaacaattgatattgtctttatttcattttgtagctcttcatctgataatgtatctataaatgatgattcaactgccctcatattattctttaataatccaagttcgtctcctatcgccttagctgttactatattatcacctgtaagcattttaacttctacatgagctttatttgctgtataaacagattctttaacatcttctcttaaaggatctcttattcctacaaaaccagtaaatactaatccatcatcactttcttcaaaagaagcatcatttaacgtttctgctgctgcttctaaactgcttgcctcaatctttttgtatgcaaatcctaatgctctcattgattttatctgaagcttttctatttcccttaagatttcattttttacttcagatgttaattccattactttgttttccttttgtatgtatgaacatctatttaatattatttctggagcaccttttgataatagtatataatcgtcattttctcgtattattgttgtcattctctttaattctgaactaaaaggtttttgagatactatttctgatgaatttctatactctctgtaatcttcatctttgttataaagaagcaaagcacattcagttgcacttccaatatatttataagttccatcaaggtcttcaatatctgctgttgaattaagcagacaattttcaagaaaatatccttgtccacttttttcggcatcatccatatatccaccgttattatatactacttcaactgtcattctattttgtgtaagagtaccagttttatctgaacatatgacagatactgaacctatagtttcacaagcttctttctttgtaacaagtgcatttatttttgccattttattcatagttactgcaagtgtcatattgactaatgttggaagtccttcaggtactgctgcaacaataagagcaacacatactgtaaatgctgttttcactggttctattgactctaaaaatggtattattcctgacgcatctatattaagcacatttttcattaccatatttacaatcattaaaataaatagtaaccctgcaagagcaccagatattttagttatttttccacctaagtctccaagtttaacttgaagaggtgtctcaatgtcatcttgtgaaagattttcagctatctttcccatttcagtgttgtcccctacagaagtaacaatcattgttcctcttccataagcaactaaagtcccaccaaatagcatatttaattgttttgcaggaacaggatcttgtaaaatttccttccccttaacatctaacttttccattgatacaataatattttcattttttctaacatcatcagattcaccagtaagcatatcttctcttattttaagatttatactttgtacaagtcttccatctgctggaatcatatctcctgtttcaaaagatacaatatcaccaacaacaatttcatttttaggaatctgatgaacgcttccatttcttattacttttacttcaatgttttctgttaatttagaaagagcttcagcagccttttttgattttccctctgttatcatgcctattccaacaccaagaacaattgccccaactatccctactgaatcagtaaattctccaataagtgcactaattaatgcagctgctatcaatattagtatcataggttcgcttaatgcttcttttaaatcctgtaaaaaacctccttcttctttaactgtaaattcattttttccgtatttttcttttcttttagctacttcttcatttgacacacccttagaaatttcaacgtctaattctttagcaacttcttctgaacttttactataaaatttcaaatctccacacacctttcctaaacatgtcctaaactttgcagtttaatctttataatctttattttaaatttattccacactaaacaaaaaagcgagattcatgtacaacaaaaatgctgtacatgagtctcgctttttaagattagaccagatacattctaatgacgtatcatgattgttgatctaatcacatattatatatgcaaactactccccaggaacatgtttaattcaaaatacattgttttttatatattatcttatttatatatacttgtcaacacatagttttatgcctcatatgcttattattaatcagtttttttattcagttgaaattctttatgaaattcccatgtattttttacccatttgtatatagtaacattatcaaaatcacatttaaattcaaatggatatttattcacatattgccatacttcttcaaaaataggaggaacttttttggatgttagagtcacatgaaactttttgtctctcccatcatttttattgaaatttatatatggatatttttctaaaacatcaattaatttatcatgaaatttttttccttccttggacatgttaacatccatataaactacccggttatcaaaatggttgtattttttcattgtaaagctttttattttttcattgctacataatccctcaagatctttctctagagaagttatatctccttcatactcaaatggcgcctttattgtaaaatgtggtggaagtttcgatgattttgctttaaatttatcataaatatccattcttaaaatatcattaaattcccccgcttctcccttaactacagaaacaataacatatctcataatatactaagcagaactatgctgaaatttattatgtccattttcttcattatctgctttcctcctttttataataatatatacttttataaataaatattagttactacaaattgcaatatatatttttaactttcttacaatttattaattacaaattcaaatatatattattataattcttttcttctaaaaatatatctgtttttagaagaatattatttttaatcatattgttattttactcttatctataaaagcaataaatctaaataattagatagtttaaaataagattttctatacaactaaaaacacagaactcaaaaaaagttctgtgtttttatgaaattaattttaaaatcctatttttcgtcttttaaatatcctgcaatattaaatgcatgatccgagactctttcaagatttcctattatatccatgaaaagtacaccactttcaatgttgcactcttcatctaaaagccttgatatgtatctttcacgtatatcctgttctattaaatctacctcatcttcatatttcaatacatcttttataagatcagtatttcctgattttctcgcttcaagagatgcatttaaagattgaagaactttttcattcattctttctagttcacttattactttatctgaaaatttcagattatcatttttcatagtttctgcaaattcagctatatttttagcatgatccccaaccctttcaagatcattaattgtatacagaagattttttactgttttatgctgtaaatcattcaaacttaaattatttattttaacaagataagatgctatggatttttcatacttatttattttcttttcattttcatagaccttctgtatatcttcataatctccgtacattgcagcattaattgaaagacgtgtattttcataggctagaattcccatttcattaatttccttcaaagttgcttctattgcaaaagaaggagttttcattattctatcatcaagatgattttctaatgataattctgaagattcattctctacctttccctctttcactatgatacaagatactttaaccaatagattagctattggaaacattataatcgtattaacaacattaaatatagtgtggaaaatggaaatctgaacactatcaatagttgcattggcaattgtcttattaacagtaaatacaccaaatccgattaatgcaaatattaaaactccaaaacaattaaatagtaaatttattattgcggctctttttgaattttttgaagcaccaatacttgaaagaagcgctgtatagcatgacccaatattggatccaagacatatatatacagcagcattagttgtaacaacaccattcattgctaaagtctgaagtacaccaacagatgctgatgaactctgcattactgcagtaacaattgctccaaccaaaactccaaggaaaggattacttcctagcaaagcaaaggcttgtgcaaatataggggcatcagtatatggttttattgcacctgacatccagtcaagtcctacaaataaaagacctaatgatattaatatctctcctatatttttctttttttccttctttgcaaacataacaagcatagcacctataccaatcataagtggtgcataaaaactcggcttcattacagtaaaagcatctccaagctgacctgctgatacaatccatgctgttattgtagtacctatattagctcccataattactccaacggtctggaaaagattcatcaaacctgcattaacaaatcctataaccataactgtagtagctcctgagctttgtataattgctgtaatcaatgcacctaccaatattcccataaatcgattgttagtaagaacacctaataaatgtttcattttatctccagcagttttttgaagacctgttgccatcatctgcattccataaaggaacattcctagtcctccgacaaactgaaacatcattgaaaaatcatcaaatgtcataatttcttctcccttaaaaatgaaaaaactttttatttagtaaataacatttacttttaaaattacccctcgattttctattataagataaataataattttattctatatttttattaatctattcgttaattttctacatttttatacattttatatctctgttaaaaatatgttaaaaattctgctttccatttgactattcgaataaattataatcataaaatcaacataatctattctttatattgatcttttttgtatatatcgtttctcattataattaatcaaccttaattttagcttaataaataaaaattccagaatcagtctttataaagtatactgattctggaatttaatatatttttaatttttctttctgaatacaccaattctcatatccacggttatgcttaaatctttatattcttcaagcttttccttgttttctggagttgatttccaataatgaggtgtcatttttaaaagacttgtaaattcttcattattcaaatccagatcatatgtaacattaacttccttaatgtaatcatctttttcactatcaggtttataaactttctcattaagattaacaacagagtatataatatttctaagttctataagatgatttgttcttggaagaactcttacaaaaatgccatccttctttaataccctatttatctcatctatatcaattggactaaataccgataaaatacaatcaacagaattatctttagcaggtatatgatagttattgccaaccacaaataaacattctttttcgcttctgcttgcatattttaccgcttctttcgatacatccatcccgtaaaaatctgcttctatattatttatttttatagcttttttcaaattagtaaggtaatatccttcaccacatcccacatcaagaacatttatcttttcctctgaatctttgaaatactcgcatattacttcatttattttatcacttatttttttataaaatcctcttctaagaaaatctactcttgcaagaaccatatcttttgaatcaccaggatttttgcttcttttcatattgcttattaataagtttacatatccttgctttgcaatatcatacgaatgattttgttcacacttataaactttactttcagattctttttgtaaattctccccacagattggacacgttaataaaattttattatctatattcttcataaattgcaactctctttctataattcactaattactatacactttttctttagtgttaacaatacaattgtctttattgcaccatataactcttattacttaagattataattcatataaaactaatactagaaaacatatttttctcaaaaatatacactattataaatagaactgcccttataaaattattaaggcagttctatttttctatagttttttataataaatctttactttttaaatatttaaatgtaagcattgttatgtcatctgtttgcttttcatctttacaaaaattatcaatatcttttcttaccattggaatcattccatatatatctacatactgcatactttctttattcaatacatctttaagtctattcattccatataaatttccatatgaatccatggcttctgtaacaccatcagtatatacaaacagtatatcatccttctgcaaattcatttcctgcttttcaaaatcggcatttggtattattccaaggatacagttattttttatgttaatgtactcaaaagttccaaagtcatgctttaaaagcggtggcgtatgtcccgcattaacatatgtcataacaccttttttcaaatctattattcctaagaatgctgtcacaaacattaaagcttcgttgttttcacatagttcattgttaacttttcttacaacttctcttatatctgaagaagataaaaaagaattctttataacactttttgcagtcatcataaatagtgctgctggaacaccttttcctgaaacatctgctataacaaatgctaatttatctccaaaaagataaaaatcataaaaatctccgctgacaccttttgctggtctcatatttgcaaacacctcaaagtcatctctttgaggaaaggctggaaaaatattaggaagaagcgaagactgtatcttcgttgctgccattaattcagcctcagctttttctttttctatagcagcttcttcaatatttttaacatattcttgtatatcactcatcatcttgcaaaaagcatttgcaagctcttctatttcatcaccagtttttatagcttcacattgggtttttaaatccttttgattaacaattttttcatagtcaccttttgcaaatctcttaaccacgttaaataaaatctgaataggaactgtaattgtattctccacatattttaaagctaaaagagcaactgcaaatataaaataacttgctataccaataataatataaacctgactacaacgctcagaatcaatataattattaagcgatacatatcctagtatatataaaagtcctataaatataataacaaaaattaaaagtcctatggtaacttttccttttatagaaaaggctccttttatctttgaaatttcaatggtatttcctttatttattattggtgtcacaataaacaaaatcataagagcatatgaaattaataatattgttataacttcaatatttctacttaatgataaatcactttgttgcaacactattccatatatccccaaaaacgaactgaaatacagaagatattcataatgcatattctttagtacagtagattttgttttaggaatatgaggccgtatttctgttgtagaaaatataattaatataagaactcctattattgcttgaaaattataattattaaaaaattcaagcaatacaattttcaagtttatactacttttttctactaagcctattgatagttttgatagtaaagttactgttatagaatctaaaaatatgatataaatatatcttaagatccccttaatatcattgaggtttggtatttcacacttatcttttatattaaatgtataccataatttatatggtatatatgcatataaaaaatcaaaaaataaatttataagatgaacattaaaactacttccatcttttactatggtagcaaaaaaatttcctgctgcacaagccatagcaccaactgcaccaaaatacaatcctataacaggagggaaaacactttctacctttatttctataatgctaggtataaatcccctcatacttttaaataacaatgcacatataaatataaataatgaacatattattccttttttaatttgaatcttatttatatttaatgagaaatttttattcaaaaaatttcactcctccaaaacttataaatcacagtaaatcattttatccattttagcttataatatgctattccaaaacaaatataatagtatatattgcttgacatgtgctgctccttgtgagcaattatcacttttggttgatatcattatgtcatttctaaattataagtataaaatttataatgcaacatatatattttttaagcatactacatttattcggctactttgatccttttatagaattgtaatgcttttttattgtaagtatattcatgcctttattcctctcatattgaatgaaatcagaaatttttttaattaaaaaaaccccaaggcctcctatatccctttccataatatcacatgtaagatctggatctttttcttctatgggattaaatttcactccatagtcacacatttttaagactacataattattattttcatcatattcatatccaataagcatctcaccagtatcatcatcttcttcatatgcataactgattatattcataagaacttcctcacataaaagcctaatctccatgtcaatatgctctgtcaccattacatcttttttaaggttattcagtataaaatcgatcattgtgttcaagttatttaatgtggcttcttttcttaaccattccataaaatcacctacactcttattatataagctcgtttaaattatttttttcatcttaaggtctgtaggttattttccaagtaatattattatactccttggatttacaactatatgcttttggtcatctattggtattcttatcttttcatcaaaaatgtcttttccatattcacacgaagtattacagaatatataccactttttatcttctggtattataggaagttcataaacatgcatttcccaatgcatgtttattgccatatatatgaatgtatcctcttcaactttatacttctctttttcttcaacatacataatggcaagtgaaagattatcatttgaaacattaaaactccatggtttttcaccatgccatgaaagttcaggatatcctgtcttattgtttttcatatcatatgtggaattttttaatactggatgagattttctaaaatttatcatagctttaaaataattatatatatcatcatatatttttaagttatcccaattaatccatgagatctcattatcttgacaatatgcattattatttccaaattgtgtattacagaattcatctccacacaaaatcatgggtatacctctactcataagaagaatagttattgcattttttatctgcttctttcttaattcatttatggaaacatcatttgtttcaccttcaaaaccacaattccagctattattatcatcagttccatccatgttattttcaccatttgctttgttatgctttccattatatgaaactaaatcatataacgtaaaaccatcatgacatgttataaagttaatagatgcatttgaagttctttggttatataaatcttgagaaccttccattcttttcatgaattcaagagctacattatcaccttttaaaaattttctaacagtatctctgtattttccattccattctgcccatcttccccatgaaggaaaattcccaacctggtagagtcctccagcatcccaagcctctgctataagcttgctctttgacaaaatagcatcatgtgcaagagtttcaagaagaggtggattcttcattggagcaccattttcatctcttgataaaattgaagcaagatcaaatctaaaaccatctatatgatactccgatacccaatatcttaagcaatcaagtatataatttctaacaattgaattattacaatttaacgtatttccacatccactaaaattataatattgtccttctggatttaatagataatatgtcttgttatctattcccctataagatatatatggtcccttttcattaccttctgctgtatgattaaatacaacatctagtattacttcaattccagcctgatgaaatttttttattaaatttttaagttcatctgcttccattccatattttcctgtagcggcatagccagcttttggtgcaaaaaaatttactgtactatatccccagtaattaagcagtctttttccatcaatagttcgtgcattctcaagttcatcaaactcaaatataggaagaagttctatgcagttaataccaagattcttaagataaggtatcttttcacttaaaccagcaaaagttccaccatgctttagaccacttgatgaatgtttagtaaaactccttacatgagtttcataaattattagttcttccataggggtttcaagaggcttgtctccatcccaatcaaaatcatcgtacataatttttcctctatgttgaaatttattctcttcatcaatttcttcgcaccatatacttcttcccgaaacagatttcgcatatggatcaagaagatatttttctttattaaaccaaaatccttcagagggtgaaaatttcccatccattctatacccatattctacattttcataatcaatatcaaaaacgatcattgaaaaaacgtcaccaattctaaattcatctgggaatggtattattgcatatggttccttttccctttttctaaaaagaacaagttcacatgatgtagcatattttgaaaacacagaaaaattaacaccattaggaacaatagatgctccatatggcagaacctttcctattctatatttaattccatctttttcatgagtaggatagctatcaacacgtatcatttatgatcctccccttatttttgaataacttttaatgctcaaatcctttgaaaatattactaaacccagtcatttccataacttctttaacttcttcaactagatttacaatattcatatgtccgcttttcatctttatgctttttcctattgttagaagtgtccttaatcctgcacttgaaacatatgaacatttgctcatatctattgttatatcactttcatcttttattacatctaagattttttcagtgacctcattacttgaattgctatcgagcttacctttcagttctatatattttttatggttaacatcctttatacttacttccacactaatcacaaccttatttacaacattattaatttcatcttattattccattttaatttaaatctacctatactagattatggccacataaaattaaaaaattcaatttatattaaattaattattttttctttatttaatgttcattatcaattataacacattttttaaaatttttaccaatattttttataaagtgacacaatacaatattgtcttttaatatagaatttatttatattatatcctcatataataattattcattaacacaagattttaccacacaatatcctcttacaaatatatctttattgttttctaatttataatacgttatctaatttcctattataatttatttatttagatgatatgtcaaattataaaattgttcataccctagtaattttattcaaataattatagatacgcaatatacaaaaaactacctcatataaataaaaatttatatgaggtagtttttttatataaattacgctgtaacttcttctaattgctcacttttaccatcaacaataaagtttacaattttctctcctactggaagacataattgtatgaatggtccgatggatattaatgaaaggacagttcctataccaattgttccgcctaagaaaaatcctccaattaaaaatactgcatcaagacatattctaacccatctatactcaactttagttttatctacaataatgaatggaactatgtcatttggtgctacacctaaattactagcagataaaactgaaaatcctactgctattataaaacatccaaacactactaataacatttttacaaataaattataagattctactgggaaatatgacattatttttatacctaaatcaataattggccctacacctactacgcatattaatgttccaatattaatacgttttctttccgtgcataatattattgcaaacattactataagtataatcatattagctacaccaggtgttactccctgattccctgatatcatattgacaattgtactatcttttaaaaatgtattatcaagtgtcgtcgccagtccttgtgtgaaaacagtaaaagtatccgaaccgatgttagtctttaaaaataaagctactcctaactgaataatactcattcctataaagaataatataattcttttaactaaattaattccatgtttcatttttctcttcctttactatgtatattgctacatctattttcatatttaataaataataaaagcagactaataaaaactagtccacttttattattctacaatcaaacagtcattttgtcaaacgtttgcgcatatttttttaaattttttcatccaaatacattcatattccttcatttatactcattttttaccaatatataattatatttactcacaatctgtatcatctaatttcacattttctaagtaatctataaactcttttgtttttgaccaatattttattccccaattgtcaaaattccattcttccatataatcattacactcataatctatatagtaaagtacatcatctttcactacaaaatttgtaggaaaataatctatattagtctttgatgcatataaaaccctgcacatttctttaacatcatcaatataacagtccttcattctatcatttaaaataatatcaaaaatagtatcaccttcgataaattcttttaatatcctttcttcttttatatctacgtctatcatcaacggcattcttattccaattttctttaatctgtcataatcatttaattcactttgtatcttatctccaaacttataataaggacacggttcatgatgtatctgtttcaaaacataatatacacctttattttctactaaatatgaatatccaccctttccttttccaagtaacttgataatcttataatcattattattaacattcatattatttcacctcacaaaaaagactttctataataatagtatatttatatataccttatcatagaaagtctttttatattatttatttttttcactattaaaagataatacagagcttaagaaaatagttatgcaaaccacacttgtagtagatattataatactcattatttttgccaatactgttacaggtacaatatcaccatatcctatggttgtaaaagttattattgtataataaaataaatcaaaattattgggatttccagtatatgaattaatatctgcactgtttataaaacaaacagctaagaataaatttaaaatcatcattatcaaaatgagtattgccaatgttgttgtacttttaaaatttctatatttctccaaatgaatatttatgtgttctggattttttattatttttataagaacccttaaattcatcatataacaaattgctacgcctatcaatcctataaaatagcactcttcaaactgtttaggaaatacaataagtaccgtaaaataggtatttaatacgaaataacttattagcaaatcatacttaatatttgaatcttcaactttactcaaaagtttaaaaatcattgatgatgataaaaggacatatccaacagcaagatatagcataaaaatcattgcaattataattataatttttataattaagtttattagataatttgaactaaaattaatataaatactcacagctgaaattacattaaaactcatgaatatttgagctaaaatgagcaatgctgtttgaagaatacttccaatacttgttcttgttatgtctttaaacaaccctaaataataatgtgttatttcaattataagaatcttaaaaccttttaatatttttttataatatatatttctaattgcaacaattagtattattattaaagttgcaataatcataactagttttcccaatttaatctcctcaagctataatcatagtattttttaaataagctcaatacatacaaacttctttttacctatttgtattatcattttatcttcaatttcgactttacttaaatcagaaattttattttcatttacttttaatcccccttgattagatattcttcttaattcatttttacttttaacaaaattgttatttacaagtatttcacttatatctaaattatttttatttacttttattacttctatattatcaggaatctgtcctttttggaaaacttttttaaatctttcttctgctgactttgttttttcttcattgttgtacaataaagttatttctcttgcaagcctcatttttatatctcttggattaatacttccatcatttaactctttctctattccctcaattatatcaggatgtatatctgtcactaaattaaagtattttattataagttcatcaggaattctcattgctttttcaaacattacatctgcatcttcatcaattccaatataattaccaagacttttactcattttttcttttccatcaagtccttctaaaagtggcatgaatattgtagtttgtgattcttgaccatattccttctgaagcattcttcccataagcacattaaatctttgatcagttcccccaagctcaatatcagcattaagcacaacagagtcatatccctgcataagtgggtaaaagaattcatgtatagatattggaatctgactttcatatctctttttaaaatcttccctctcaagcattcttgcaactgtcattgttgatgcaagctttatagtttcttcaaatgatagctttgatagccattcactattaaatctaacatcagtcttttccttatctaaaattttaaaaatctgtttttcgtaagtttttgcattttctagaacctgttcagttgataatgcttttctgcccttagccttacctgtaggatcccctattttacctgtaaaatctcctattataattactattttatgacctaagtcttgaagctgtttcatctttctaagaactactgtatgacctaaatgtatatctggtgcacttggatcaagacctaattttactataagtggtgtgttttcttcattagattttttcaatttctcctttaatgtatcaagtccaattatttcatctgcacctttcataattatttttatttgttcatctatatttatcatatttacttcctccaatatttcttttttatttttataattaacatataaaactcttaacatagattatttaataaattggtataactttcttcaataaattcaatctatggactttattaaattgtaataactaataacgaaatatttttggcgccatatattttttaataattatcaagcaaacagattatcttgatcagagataatttaatttttaaaagctactttgcacatatttttatacaaaacaaaaaagccttcgtccttaactgtaaaggacgaaagcaatacttacgtgttaccaccttattttatcattatttcacaataacaacctcttcaagtactcagatataaatttaataataatctggttatactctagcactataacgtgtgcaaattacgacatctgcctactggttgttatctttcggagtgctgctcagagacgtattcaaattaacttgttatgttcctttcaccacccggaacctctctttataactctattaatcttactctttctcttcaaagctttaatatttgttttacttgatgtctcatattctacacatattcttctattttgtcaacattcatattataattttataaagaataaaatatatttcgatgaaaatattataaataatgttaaaattctactgtaaagtttatatattatacttaaatctttaataaaaattattaaaaataaaaaatgcagatttaaactttaactctgcattttttattagtgtctaattttaatataaattataattaattaaagtacattctccacatcatcaagcattttatcaagagccttaaatcctgctcccccaacataccatgctactgcatcaacatatactatcttatcattaatataagcattagttgttttaaccaattcattttcaactgtttctttggctggatttccacttccagttacagcacccttatctataacaaataagtaatctggatttttttctgctaaatattcatatgatatactttgtccatgattagatacctctatagaagcatcagttggtttaaatcctaattcattgtaaagtatattaaatcttgatccagaaccataaacactcattgaaccatcactaaccattgttgctaaagcatttaaattattacctgtaactttttctttgatttcattaactctcacatcaatagtcgataacttttcttctacttctttttctttatcaaatatttgtccaataacttttgaattatttttcacactatttaaataatctgaacccacagagccaaggaaaactgttggcgcaatttttgataattcttctaacgaatcttcctgtcttccctctattattattaaatcaggattaagttcatttattgtttcaaagttaaactctttaactcctccaacatctgtatacttttcatcttcatatttatttaaatattctggtagccccgatttaggcactcccactacattatcaacaccaatttcctctagtacatccagtgttccataatctaaaactacgactctctcaggatttttaggtacttccatttcaccttttctatctgtaacagttattttttctatatttgtactattattttcttttaccttaccacatccagctaaaagccctgcagccacaaccgtagtcaataatgcacttaataatcttttctttttcatttaaaattcctcctaattatgtatatgattttcattatcactcttttattataattaattattatttatcttacttttagaaatagatacaaattttattaccattaatctccttaatatcaaaatctatttcatatatatcttctaatatttttttatctataatattatcagttttatcatcttttgctaactttccattttttaaaacaactatattatcagaatatactgaagcaaaatttatatcatgcattactattacaactgtttttccaagttcatcaacaagtcttctaaataccttcatcattgaaactgagtgtttcatatccaagttatttaatggctcatcaagtaatacatattctgtattttgtgcgatgaccattgctatatatgccctttgtctctgccctccacttagttcatcaagatacctatcttcaatatctttaagttccatatactcaatggcctcattaacatacttttcatcttcttctgtgagtcttccttcacaatgaggatatcttccaaaacttacaatttcttttatagtaagtcttacatttatattgttagactgctttaaaattgaaatcttttttgcaagttcctttgggtcatatttttcaagctcacatccatctattgtaacagttccagaatctttatccataatgcgtgaaatcattgataatactgtactttttccagcaccatttggacctataaatgaagttatctttcctttttctatatttaacgaaacattatctactactattttgcttccatacttcttcatgagattttttacttcaatcatttttttcctccataaaaaattactatacttaatagaaatctttattttttattatattaaaatttaagatttactcgaagctaatttctagcctgctttaacaataggtatataaagtatattccacctatgaaatttattattatacttacagtagatgaaaaatttaatattctttctactatgaattgtcctccaacaactgcactcatacttataagtgaagaaccagcaattagatagctgtgtttatatgtcttgaataagtgatacgataagttcacaaccagaattcctaaaaacgtaatcggtcctacaagtgctgttgatactgatacaagaatagctacaataagaagtatctttttagataagctatcatgatcaacacctaaatttattgcttgttctcttccaagtagcattacatcaagcttacttagatctttataaataaagcatccagttcctattataattattactgcaataagcagtatgtcagtgttaacattgttaaaactagcaaacatcttattttgtagtactataaaatcattaggatcaataagtactgacatgaaagaactcatgcttctaaataaagttccaactacagttccaactaaaagcaaagtaaatatattcttacccttcttaaaaaccaagttatataataatattgttccaagaagcattattgatacagaagcaaaaaagttcatttttttatctgtcatcataatactatttacaccaaatgcaaatatgcacaatgtctgtccaaaattatacaatgagtccaaacctaaaatacttggcgtaagaattctattatttgtaactgtctgaaatagcatcgatgatacagcaatgcttgttccagttaggcacattgctattattttaggtattcttctgcttatgttataatcaaaatttctagaatttaatccttgaaaaagaaataaccctatacatattattgttaatgctgaaagaattagtattttcttcttatctctgctatgcttcatttctatttctccttaatattaaataaaggaatattatacttcctataactcctacagtaagacttattgaaacctcatatggataaattacaagtcttccaattatgtcacataaaatcacaaaatttgctccaaacaaagctgtaattcctatatttttacttacattatctccattaaaaagtgatactaaattgggaacaattaaacctataaatggtatattacctactgttataataaccagtgcactaactaatgccactatggtaattccaatattactgactttcttataatcaagacctagattttttgaaatatcttctcccatacctattattgtaaatttgtttgcatacataaatgccactataagcaaaggaatagtgaaatatagcatttcataatttcctttaatcacaagtgcaaatttaccttgaaagaaagatcccacattttgaacaaggttattcttataggctataaactctgtaagtgatccgataacatttccaaccataatccctacaagtggtatgaatatggcatttttcatctttatcttttttagaattcccataaataaaaatgttcctataagtgaaaatataaaggctacaatcatcttttgcgttaaagatgcaactgggaaaatcatcatagctacaattacaccaaattgtgctgaatcaagagttgctgctgttgtgggtgatacaaatttgttgttacttatctgctgcattatcactccaccgatactcattccaacaccagcaacaacaagcccaacaagtcttggtaatctgcttatcaataaaatatttattttctcactatcaaagtttattatatccattactgatatgtcgttcactccaatgaacagtgaaattatacacaatataataaacatcggtattaatatttttttactcataatcatcataacttctcattttactttttgcttaacttaatactaaaaatatgatttgcaaaataaaactttgaagtaaattctcctttcaaaatcacaatcaattaataatatatattaactgaaatatactatcattatgtttattataatactgataatctttttcaatgtcaaggatttcttatcaaaataatatgaattagcaatttctatgaaaaattcatttaaaaaatgttatattatgactaattttgcagatttaacagctattagtcaaaaaagcaccattaaagaaattataatttctttaatggtgctttcttaaaatctgctatttatttttaatctttgcttttattccatcataaagatacataagatattctacatcaaagccgaatttttccactttatcaattctttcttttgccataactatagtatgtttcgcttctctataatctttatctttaatgcaggtacttgtatattctaatagataatctgcttttaaaacatcttctgccaaatcctctctgtcagcattaactagttcaactaacattgaatatatcttaggtgatgttgtatttttagtatctgttaatatgtctgtatttctactactttttcttgccataatgattccacctcattccaatggaattataacaaattttatatattttttgcaatagatttaatttaacagcaagtctcttgaatttctgatactttttctttaaatataacattcgaaacaaaaaaaactgcaaaagtaactataaacattggataagctaaatctgcaaatattacatttaatactggcatctgtgaaaaatatgatttaactggcaaagcaacccatataaggaccatcaaaattccacttaatactgtgtaaaatgctgatttttttgaaacataatttttaaaccatattccaccaagaacaacaatagatacaggtattgaaagtgataatgcagtttttattgttgttataatttgtcccttttgcatggctaacacataagtaataactccaacacctaatattattagcttattccatagtaatgaatttttttcaattatatctttaagctttgttttagctaatatatcttgactgacagtagtagaacatcctataagcatactacatgctgttgacatatctgctgcccaaagtccagcaagtgttattcctgcaataaatggagataatgataaaattataactggtagagctcttgttgctggttctaagtcaggataaatagcttttgcacatattcctaataaagcacataagaatccaattggtatcattattatagcagctaatttaaatcctttctttgcatcttcatcgctttttgaagtaagacctatttgaaccactccttgtagtgaggtacagttagctgtcatggttataattaatgcaagtatactaaaaataacaactccttcccttccttcaaaaggactgaaaaagttctgaggattttgagaattaaattctatggcagcttgaagtccattcattccaacattaggattattagtaaaaagtacaattccagtggttactataactccaaaatatataagagcaatatttaaaatattgcttatacttgcagaacccattcctccaataagggaaataagcataaacataataaaactaaaaaatattcccatattcgcatcaaacacatctggaagtagacttgcaagaatagctccaccagctttgtattgaagtgatattattgcacactgcataataacctgagctataataattataaatgctgcctttttatcataaattacttcaagcatttttgctattgtattaaatccactttttctaaacttagatattacaaaataagcagctgcaagtgctccacttgcccatgctacgttataccatcctgcactcatgccatctgatactgcattttctgctattcctattgtagatgctcctccaatggcaaggcctgctactgttactgctgtaataattgcattattttttcctttatataataaaaacgcttccccatcttttttttgtttttttgaaataataacacttatagccataagcacaccaatgtatactaatactattataagtggaatcatcgtcgcactattattcatatttactccttccatgcagaataatcctactctgcaataaccttcttatcctacttaaaaaaaactaaatttcttttgatttttcaatgtaacttcttataatattgcacgaattattaaatttttccttttcattatttgtaagatttatttcaataatctcttctataccatccttactcataatgactggtacacttgcaaaaacatcagtttgtccatattcaccatttaacaatgttgttgccggtagaatctttctttcattatgaagaatcgtttttacaatttcagtaagtccaacgcctataccaaattctgtacatccttttcctgctattatttcatatgcagcaaatgcagctcttttttcaatatcatctaaatctaaatttccaaatgttttaggcttttcttttataagatcaaatattggctttccacctaaagatacatgagaccatggaaccatttgtgaatcaccatgttccccatagtatacccttgaattgactttgcatctattcctgtttcatgtgataatattcgtctaagtcttgatgaatctagagttgttcctgttccaaatactctatttttaggtaatttcgtcttttccaatatataattcgcaacaacatctactggatttgaaataacaactataataccatcaaaaccacttttcataataggttcaataatcgtatccacttctcttattgttccttctaaaaagtctagtctgcttttatttggttctggaggcaccccaagactaactacaataatatctgcatcactacagtcttcaaatgttccttttctgcttgtaacataatgaggaagatatgaaacagtatcacttaaatcaacagcttcagcatttgcttttttttctattttgtctatcattattatttcatcacatactccctgaactgctagtgaaaaagcacaatgtgatcctacatttccacttcctactataactacttttcttgttttaattgacatgaattttcccccttttattcattgctcatatgcatactttaataaatattgccgagtatttttatcaaagtaataattaattttctaattattagtcatattttaattattgtactttatttttaattattagtcaattctccctattattttcattttatatcgtatattttttataatttcattaaaaacacaaaagtctatacataaagtatagacttcgttagcattttttcgctaaatatatttttttcctaggaagcatctgaaagtttttcaatgatattatttctattatcatctttaatcttattgaatacactatctaatatgactcgccttaagttaggtgatgatttatatattttatctatatcattaaatccttcttcataattataaagaatttcaccaacaaatttacttaaatataaatcattaatattgtacttgccattatagttataaacttcttcaattatccatctgtttgtatcattacctataacctcttcaagaatattgaaggtatcgtttacagaaactctatgtttctttattatctcaaaaaacttagttaatttactgtttatttctgaaatactgttagatttctttatttctccaaaatatgatacatactgtgcatcactcattaattcacttgaaacagtttcatctatagattctttatttttgtcaagtttcttttgtatacttttatgaagtatatttaaaatgtatattatcataattaacccccgaaatttatcaaaatttttaaattatacgctttattaaacctttacatattcagtttacatcattttttcttttatttcaaatatttttttattaatttaaacattatttaagaaaatttaagtttaaattaagattatcttatgatatcattttatggtaattaatactatgaaaactattttattacactagtattatttttagaattcggaggtaataataatgaattatgagattttacatgaaggtacttttccaatggtaaaatgtcaccttgaacatggtgaacaaatcaaagctgaatcaaatgcaatgataacaatgtctcctacaatagatgtaactggaaatactgaaggcggaatatttaaaggcattgcaagaatggctgctggtgaaaaattctttttccaacacttatctgctaatagaggtgctggagatattatttttgctcattctctaccaggagatattgtacctataacattaaatggtacaggccttaaaattcaaaaggacggttttttagcctcaactatagatgtagatcttgaaacaaaagtccaaaatcttactaaaggattattttcaggtgaaggtttttttgttcttggcgcaagaggacaaggtactgtttttgtaagcagttatggtgctatacatgaaattaatttaaattctaatgaagaaataataattgataactctcatcttgttgcttgggatgaaacacttgaatacaatatagaaaaggcttctaaaaaaggatggataagcagtttcacttctggcgaaggacttgtatgtcgttttaaaggacctgggaaaatatttattcaaacacgtaatccagatggaatgaaaaattggatagcaaaaatgggctttaaaacttgttaatattttaaaattacataaagtttagttatattgaatatataatctattatattaaaaagaaaactaaaacaaggtacaaacttgttttagttttctttttaaatatgttcttattttttatattattttaccttttataagaataaatgaataaaaaattgttaattaactcataataatgttattaagtattactagaactgctgcttgtacttgattctaaaattcttcctgcatacttcatatttgatgttgataattgacttatctttacaacatctccagtatgcggtgcatgaatatacatatcattccctatatacataccaacatgtgttgaatcagaagatttattaaatactaaatctcctggctttatttcagacatagaaatctttgtactaaaactttgctgatcttgtgaaactctaggaattgatatattttttgatgcaaatatatactgcatataaccagaacaatcaaatccatcaggagttgttccccccataaatatggaactccaagatatttctcagcttctaatataattgcttttgcttcttctgaaatatctgatggcaatgttacaggtattatattattagtacttaaatctagaagactactattttcttttacatagtctatcaacttttctttatctgtttctaattcttttatttcattttctaaatactctttacttttttcaagttctttttgctctttttctatattttcctttatttgtgtaagattatctttagcatctttggcattttgaataagttttttatcgcttgtacatatcttagatataagatgaactttttgaactgcatctaatatatcctcagatgataaaagtgcatcaagatacttcataggtgtagattcaataccaccatttttttgaataatatttaatctctctgctaatgcattatctttttcttctatgtctgcttctgcaagttcaattttttgttcattttcatgtatctgattttctttttcaagaatttgttcttttaactcatttaattttcccattttatattcaatttgactatcacattcttgtatattctgaataattttttctatggatctattatctgtaccatcattggctgttatttcagtatcagcagctactgtctcatttggagctgcaaaaacaggcattccactagttactgtcatacatgaaattaccattaccgccactagtgtctgtatctttctacttctcatactaatctcctctaatcttatggactctcatcaataagactcacttttgtctgtatataaattaatttgaaataattaatttatatctatttacatattttatattataatatttttcttcttttctagtcaataacatataaattatatatttattaaaaaagtattactttgttcatattgaattcacaattccaatttaaattatataagctttctaaaagaatcattttacttttagaaagcttatataattagtacttattatattcttattatttgttttatattacccaaacaacaaaactgcctcaagaaattaatcttaagacagtcttcttaaccgaattattcatttaataagtcatgtatgattcttgttgcgtccatatattttgatatagatctaccatggtttaatctgttgattattcttgaacaaagttctgatatatcaacgccgtggaaccaaggtgcatcatttaattctggtgaaacatatgttaagttagagcagtatattctgcttattattccttcttcatagaatttgttaaatctttcaacaccttctgtaaagaatccaaatgttgcagcaacatatacgtttctagcatttctcttctttaattctttagctatatcaataactgattctcctgatgcaatcatatcatcaactattaatacgtccttatcagcaacatctcttcccatgtattcatgttgaactattggattcttaccatttacaattgtagaatggtctcttctcttatagaataaacctacatctactcctaatgctcctgcatagtagatggctctgtccattgctccagtatctggactgataacaagtaatttttctttatttaattctaaagacttttcatgagatacaatagcctttaccatatcatatgttggataaatattttcaaatgataataatggaattgcattttgtatgtttggatcatgaacgtcaaatgtaattatttcatctactccaagtctttctaattcttgaagtgctaatgcacagtcaagcgattctcttcctttgcgacgatgttgtcttgattcataaagaagtggcattataactgtaattctagcagccttacctctgattgcagctacagttctttttatatcttgaaaatgttcatctggacctttgtggttttctattccaaacattttatatgtacagctgtagtttcctacatcacataatatgtatatgtctctgcctcttactgtttcagaaatctttacctttccttccccatttgaaaatcttatttcatcaagaggaattaagaatgaatcactacattctctctttttttgaatatacttgtctatagcatctcctaactctttacagctttctaatgctataattccaagttcatggtttaattcagtcattggtcgctctcctttgggattattttaatataattaatatatctttaatcaattaatagtatatactaaaaaataaaatttttaaacatcattttgacttttttagcagatttgttgatactttttttcatttcatacaaatttaaatcttcttatgtcgcataattgctatattctcaaaagaatctcatttatttcttgactaatttttattctttcttcatacacccactgcacatcgaattttaaattaaatatttttgaaaacgaataatacatgtttattttttgatagtatatctcaagttcatctaaattcccaccaaaacattgtggttcaaataatttcttttgcttattcacaaaaagttcatccacatagtccaaaaaagtctccataagttcatcacgtgatacgtcaaatggcacttttaataaatcccattgaacttcttctaaaagcttatatttttttattttatctaaaatatatagatactcacttatatccatttttgtataatattcaactttttcttttcttgtactccacagtgcaagtttttcatttaaaggaaggctttttatagaaagtatagcatctgaaggacctataacagctctttctataggtgcatcttctctctcaatcttttcttttattatatgagaatttccacctactgctgctacatatcccacatcatatattcctattcttccagctctaccaccaacttgttttatttcctgagatgtaagttcacgtacttcttcaccatcaaattttcttatactcatgaatacaatcctctgtataggaagatttactcccatacctattgcatcggttgttacaagtacttttgtttctttatttacaaattgttcgtactgcattttacgcacctctggaggaaggtcaccatatataatactacattttattcctctttctgaatactcctgtgctatttcgagaactcttttcttagagaaaactacaagggcatctccatctttaacatggttgtaactaaaattcgtatcttcaacaacaagaggaattgctcttttatattcctttatttcatattcatctttgcagtcctctatcatgtctataagtaaatttttcgcatttaatgctccacatacatgtatttcatcacattgaagcccaagaactgatttactccatgccattcctctaaacgggtcacttatcatttgaatttcatctattacagcaatgtcatagtgttcttttaaattaactctttcaattgtacatgatacatgtgttgagtcagcattcacaatttcctcttcacctgtaagaagatcacactttacaccttcgttgtttagtttttcataattttcaagagcaagaattctaagaggtgataaataaacgccttttttagctgtctttagtctttctagcgctgtataagtctttcctgtatttgtatcaccaagatgtatataaaactttctcttcatgcttctagcctgtttatattcatcttttggattatcagggaaagtttcttcaaattctttacctacaagctttggaatatgcatttttgtcaacactgtcataattccagaatttaaaaatacattataatttccacgtacaacttcaaaaaaatcaaaatcagtattattctttttattatactcttcaagaagcctttgagatacatactctaataattcttcgtacttttcaactacctcactgtaatctttcaaatctatttttagttcatttaaatgacgtaatttttttcttactgaactctcatgttctataagcgctccagactttgaatgttctataatttcctctatctgatttatctgacttttatattttttgaattctcttatagctgcattatttttcactacgacacctcctgcaattattatgtccatatgattttgttttatttcttcttaattacttttattgttataaatacattcctatttaatatagtaatataaaattgacaaaaaataaaaaaagtcaccacaacttttttaaagctgctagtaacttttcattgttgcactaattataaaaattttatagaaaaacaaacttttattgttttttcaaggtataattattcagctataaaattttccattatcaacttgtctatatcttcaaactcatactcactaagtttatttttattaacccattgagcatcatcataagatttatctagaacaaatctgcccttaatttcacctttatacactctaataccttcgtcagaatcactatctaacacaaactctttataaggttctaaatcgaatataattgtctttaaaatcttattgctggctttattcaagcatttttcatcgctttccttacctcttaagttctgactaagaagtgaccattttcctatttgtcccttttttactttcttttttaaaataagtacattttcaaaatcatctttaattattagtgtgcaagcagtacatttcatcattacattctccttagttattaaatttaagataattcttttttattaattataccgtaatattaatcttttttaaatactattatgaaaaaatatactgtgtagtgaggatttatgcatagttcaaataatttaaagtcataaaattatctatattatatatttaacataaaactctcacaaaacatcacaatctcaagtcgaacttgtcgaaacacgcattataattttccacttaaattactttaaaaagccacttacaatctgttcttctgcttctttttctgttaaaccaagcgtcataagttttataagttgctctcctgcaatctttcctatagcagcttcatgtattagacttgcatcaatattattagctgttatttcaggaattgctttaacacatgcattatccattattattgcatcacattcagtatgacctgcacatttattatttccatttattttagataaaaacacctgttttgaattatcttttgcaacagatcttgaaataacattggtactagaattttcaccatttaaatcaacttcaaattccgtttctgcaaattgactgccatgagtcattattttttcctttataactaaggttgcattatcttctaatattgcctttgtagttctttttgttgagtctacacctttaatttgagtagtttccatttccatgtagccaccatcttctatattaactattgtttcaggattcaatactctttctccagttccatcaccttcaccataatgtttttcaacatattttacctttgcatttttccctatataaaatgtatgaataccatcatgttcagctttttcacttccttcattatgaattccacatcctgcaactatagtaacatctgcattttctcctatatggaaatcattataaacaagttccgtcattcctgtctgacttaaaataactggaatatgaacactttcatttttagtattttcctttatatagatgtctattccacttttatccttcttaggtactatatctacattagcagttgtatttctaagtgctacagctccatcaattcttatgttgaaagcaccttctggaatactatgtaaatctgaaatttcctttagtaaatttttttgtatatcatccataactattcttctcctttataaaatttacaatttcctgctgctgtaagtagcttaggtaataagtcatccttttttccatgagatttaatttttccaccttcaataagtacaatctcatctgcaatattaaggattctttcttgatgagatattattactatagatccatctatttctcttctcatcttttcaaacacacttatcatattattaaagctccatatatcaattcctgcttcaggctcatcaaataacgaaagcttagtacctcttgcaattatagtcgcgatttcaattctcttaagctctccccctgaaagacttccattaacttctctatctatatattctttagcgcacaatcctacttgatgtaggtaattacatgcttcctttttagtaatacttttacgtgcagcaagtcttataagatcattaactgtaatccccttaaatcttacaggctgctgaaatgcaaagcttattcctttatttgctctttctgtgatagataaatttgttatatcttctccatttaaaataatctgaccctttgtaggtgatttaattcctgtaattatttttgcaagggttgattttcccccaccatttggtcctgtaatagctataaatttcgaatcatcaatggtaagattaacatcttttaaaatttctttatcatcttctactgtaaagcagatattttttaactctaacatatattgtttcgccgctgtttatatacactaatgaaccacacattcatattctaaaataatttgcatacttaatatattttataacaaacagtcttaatttctgtatattaattatgccattaacagcaacttgctcctttctatttgactccttttatttacacattatagcacataattacataaatatcattattattgtatttatgaattttaagtaataattattatattatacaactttacctataaaatttcatataatacttgtggaagtgatattaatgaaaaatttcataaaagttatcttctatctttatataattcttattatgccgttcatgatttatatgtactcaacaaatcattcaatttcttcaaaaatgcaaaacaacgacatgttaagagcaaaaatatcatcacttgatcaattcaaagaaagcattatagatatggcaataatgagtaaatactatcttattacaggagatcaatattataaaacagaatttgaaaaaaattataatactgcatcagataatataaacaacctgtataactctgaatatataactatatctgaaaagagtaattttctgagcaatttaaatagttataaagaaattgctgaagataattcatatatagtaaattcagacaatattgatcccagtttaaaaaaacaaattcgtaaccttaccgaaatagaaactggaattatagacaacacatctaacgctctttattccagtattaaactttcagatgataatagcggttctacaatgacccttgtcagtagtcaaaataatattctcgaactcttaggtgggttttttactatgattttcctattaccattatattttgtaaataaaaattcaaacctttttacaggtataatcaaaaattttatatctgatcattttaaaaaaaagtcaaaatctccttcagtaaaaaacgaaccctgtaatgatgcaatgcttcaatgtataaatgatagtataattcagaatttacaagaaaagattaatgacagaaatatgcttgtttctacactacggataatatattcacacagtgaatttatggaaagagaatggacagaaggtaaaaatattttagattcagtagaagatgacctatcagaacttcgcaatgatcttaattccttattaaataaatctgaaattccttatgaaaaatttaacactatagaaaataaattgttggaagtaaagtttcttcttgaaaagcttccaggataccatgacttcataatgaaacttacagaaccttataaatcaaataattcaaggtagattagcaagctaatctacctcattcatgttaatacttatataatcttattttaatagagaattttaaatttacatatcctaatcatcagcttctgcgtatttctttaatatgttaactattatatcagtagccatatccataccttcaacacttatatgttcaaattcaccatgatatgcaaatccccagtaccaagattcggacatggtaatcccatataacttaatgttgctccgtctgtaccacctctgattggctctataactggttcaacacctaactctttcatagattcaactgcattatctattaaatggaaacatggttttatgtgttcaaccatatttttgtattgttcttttaatgtaacttttacagttccatcaccatatttttcattaagaagtttttcagcaagttttatagtatctttcttaactttaaatttctctgaatcatgatctcttattatatattcagcacatgcattatctgtattaccattaagtttttctaaataataaaatccttcatatccttctgtatattcaggtctttcacatgctggcaacatagaattaaattcaattgcaacattcaatgcatttaccattgtattttttgcacttccaggatgaactgagacaccgcttatttcaacttttgccatagcagcattaaagttttcataagaaatttcaccttcaactccaccatctattgtatacgcaaagtcagccccaaattcttttacattaaatagatgagctccaagtcctacttcttcatctggagtaaatcctatacatatcttaccgtgtggaatattttcatttaatattatctcacatgctgtaagaatttcagctataccagctttatcatcagctccaagaagagttgttccatctgtagttattaaagttcttcctactaagttttttaaatgtggaaatctttttggcgaaagtatgctgttatttccctttaatacgatatcatttccatcataattttctattatctgtggttttacattttcgccacatgcagcaggtgcagtatctaaatgagcaataagtcctattgcttttttgttttcatatccttttgttgcaggtatatatccatatacatagcagttttcatcgcatcttacatcttgtatttttagtgccttcatttcttctaccaaaatctttgcaagatcaaactgtctttgtgtagtaggatgacttgtagattcttcatctgatgttgtataaacttttacataatttaataaacgttcgtatgctttcatttttatctcctcttttcataactgtactctgtaaatatcttttctttggaatttttcctcttattaaattgtacacctataattttatgtgtcaaatattatgtactacaaacctgatgatactatttgtatttcacgtatttcataattataaaatgcattgatattttccatatctctttctattgtaatttttttctttccaaaacaaaatgtagtgtttttatatgcacctgttgctgtaattttacctgtcaatggtacattaagtatggtacttacagatgcagcacttccaattattcccgcacttatatttcctcctgcagataaaataccacctcttgctactgagtctctttgggtaaatagaatatctttcattgcatttaaattagaagtatactctcctcttcctccgattattatgtttccagttgattttatctcacaatcttgacaatagcctattcttacatctaatggaacaattatattcttatcataaaattcaatttcattatcgactatttcaagaagtttatttaattcataaatagattttaaatttaatatattatatcccaaaacatggtcttttatataatcaacaagcttattatgtttgattttattttttatgttcaatgaaactatatttagtgctattttctgaaaatctacaaatcttaactctgtaagggattttatcatttcaggaaaactaactgattggtcacttctatttgtctgcactacaatctgaactatatcattaagaatttctttaaattttattaaaacttctgaatattcttttttttcaatatctatctgacctgaaaaaatatttgattttatcgcatttccaagtattgtaatagttcctgcagtaacacttgacgtattaacatttctgctcacatccaacgagcctccagccttaactgccatattgtcgcttacactatcatatacttcaatatctcctgaaaattttatattacaggtttccatatttacattttcaactgcataaaccttgtttacacttattgtattattagaaatatgagcttttccatcaattaaagctataacatcattattttcaattttgcatcctgatttaatatttataggtaaacttcgaatgtattcacgtttacatacttgtcctaatacattaattccatcttttcctggaacctctggaattatttcagctattttattgcctgcatatacattagatattctaaaaagatttttataatcaatcttctcatcagaatcaggatctggaaaaaccatctgtgacggagtaaagaacaattttatgtcacttggtatgttagtaactggagcatctcctcgtgctacaagcatctctttactattcccaaaggaggcttcatataatgcctcttcatctaaaccataaataatcccattttcttttaatatattcttaagttcttctacagtaaagtgaggtggttctgttaattctccctcttctgcagcaacagcaagattcataaagacatctctatctttaagcttatactgtatttctggtatataatcaatctttatatacgctttcatcttatcttcagatattcttatatggacattccttttgctttctgtttttatacattcacattcaattttatcctttgatgtaacctcatatattccaaaaggttcacaatcaatatcatttattttcaagcatatatttttccctgctttgattgtgattttttcatcggcttcaccatcatttataataattctaccttgaaaaacctttgcaccaacttccatctttattatctcccctaataaacaatactacttctttttcatcattttactatattataacaatatttttatgtataagtatagtgatttttagtttttcaaataaattataatttcttctatgcttcttattaaataccaggtattagatttttattctaatacctctttagtataatttcatatttttatttccattttcctgtttcaatttttcttataatgtcatatactccaagactatgattattttcataatcaatcttatcttcttcacttaaactatccaaaagtatttcgctgtattttgatgacactgcccagcatctacgttctttttcaaaatcatctatacaccatttataaccattttcactatgatgactttcacagacattattaagattaaactcacatgttttgcatcctttaataattttcatattacatcacctctatatattctattatttttattatttttttattatatattttataaaagcatttattatagatgcatttttttaaaattttttaacgtaatattacaaaaacaatttaattcaattctttgttaataacattcaatgttgtataatataaaatagcataagttaatggaggaaaaatcagtgacaaaaagtataatattctttgatatcgatggaacacttttaagtgaaactacgcatcttgttccagaaagcacaaaattagctttaaagaaagctaaagataacggacatcttctttttataaatacaggaagagcatcttcaaatatagacaattacataaaagactttgaatttgatggatatgtttgtggatgtggtacatatattgagtttaaaaataaagaactcttttcaaaaacattagataacgcattttcaaaagagctagtaaaaaatataagagcatgcaaactagacggaattatagaaagtaaaacagcaacatattatgatgattttatttatggtcctgaagtaaaagaaattaaagaacaccatgttttaaaagaaggacaagtaataaaaacctttgatgatgaagatattgattgtgataaatttgttgtatggtacaatgatgaaagtgatttcgataaattccataatatttataaaaatgactttgacttcatccatagagatgtgaatttttatgaaatagtaccaaagggattttcaaaagcttcaggtattgaatttttaataaatgaacttaatattccttttgaaaatacatatgccataggtgacagtacaaatgatttgcctatgcttaaatatgtaaaaaacagcattgcaatgggcaacagtaatccccttctatttgatcttgtctcttatgtaacaactgatatagaagaagatggtatttacaaagcgttaaaacattactcattaatctaacatcaaaaaacatcactaatgcaatctacatcagtgatgttttcttattcgtctatccagtgatcttttagccattccatgtaaagaggattttcccaagttgatccatcctcatattctacatattcaatacacgcttcaattttccttatattatcattcaaaacgctccatccatattcgtacccccaagtatcaccagaattgatacttatattgtctgcaagtcctagaaatggatatgcttcactttctgattctttatttttaatttttactggattgttattttcatcatatccaaatatggtaatctcaaattttcttatatttgaatttccattgttttttagaataatctgtaattgatcaggataaagatctttgtgtgttctactggttacaattacttttccttcagtaacacttagtatttcattattcttaagttgttcttttaaatttgatattctactttgagcttcttcataattatcagtatcgtcttcattaacgagatgatatgattgaagagccattttatagtccgtatcattttcaaattttacaccatcatcaaaagcttttttagaattcatacgcatatgtatttcttcatttacagaattaacagaatcatttatctcttgatttttacttcttagcttttcaatatctgatattgcaagggcaccatcaatttcaccatcaatatagtcattcttaatctcttcaatcttatttttaataagatcatttgccttcgctatatcttcatcttttgtcagactctctgccttctttactgctttaacatacttatcattactcaaataatcatctattgtttccacgttgcttttacatcctgaaaggcaaatactaactgaacttatagtaatagccatagcaatatattttacgaactttctaatcatatattcaccccttaataacgacctattttacattatatcactgcttcaaaataaggtaaaataacataaatcaaaaaaatgaacatagtgtcatgttatcatccactatgttcattttacttaactattattgattactgctatttttttctgcaagcttaggcataattaatcctaaacctactagtactattggtgtaactacattcaggataagtttgaatttatcttctgaatacataccacctatacatgcaaatgctgtaaatgcaaagcaccatgcaccaagtaccattccaactattttatttttaacaaagaaatagtctcttccaaatttttctcctgctttcttaagagcaatgtatgctacaaatacccaaaggtaacgaagaggcatacatactgcatttaacttaacaagccacttaactaaatcatcaacgcttccaataccgaatgctggtacaataattaatatagaaacaattacaaatataagcttatgtccgtttacatatgcaccattttcatttttaacaaataacttttctggtatataacgtttatcagcacttccaagaagcattcttaaaggtgcatcaattgaaattattaacacagcaaattgtccaatcatgttagttattgcataaagtataacaaaaacatttccaacatgatagtattcaccaagtttttggaatgcataatacgctccatttgtcattaaatcctttggtacattgtttgaatcaaacatcattccaagtgatacagttccaagaatggcacatactgcaaccattatagcaagtgctatcatacctttagaaaatccagaagattctttcatttcgtttacataaggcgatatcttttcacatccacctactgcaaaaactaagatagataaacttgtgaagaatttaacatcaaatgttggcataaagctctttaatgaccaatcaatactatttaagcttgcatctgttatagcaggtgcagctatcattaatactataaataagattgacattataaacattgatgttcctgcaagtgcagaaagctttttaagtggatttaatcccttagatgcaatatacatccctattataaatataacaagacaagctaattgtaacacaactgtgttcatactacttattctgttatcttgaaatatagcccaacttgatgcaatcataaaaccagatggtttttgtgaaatataaggcatatgtacaacccagtatgtccaaccggcgtaatatgcaagttttggtcctatagtttcatgaatccatgaactaacaccaccaccatgttctctgaatgcagatcctaattcccctaccataagtgcatatggtacaaaatatatagcaaatatgattatccatgatacaattgcttttaaaccattgtattcagagaaaccattaataacatttccaaagccccaaactgttgagaatgccataaatgccagagtataccacataatttttttatcgttgttttgtgacatggttttctttctccccatttcattatttaatattttacactaaaaataataacttatttttaattaaatgtatacactttcgacatttttcctaaattaattattttttaatattgttttttcaatttgactatccatttgataaatatgtaataatctttttacattcaatgacaaaagagaaatagatattgcttgcatttaaattagttattagaatacaaaaagccatggagtaaactccacagctttcataatttttaatttattttgtttcatcagaatttccactgcatttagattttgcatgacattttgaacatccaccattacattttccttctgatgaatttttcaatgattttacaatcacatatgctgcaaatataactatcaatgccgtaataaatatttccatgattttatcatctccattaataactataagacttttttaaccaatcagtaatgttccaacattaaatactaaaaatgctacactccatgcaactataagttgaaataatactgacataatagtaaactttccaccatattcttttttcatagtacctaaaactgaaatacaaggtgtatacagaagtacaaatactaaaaatgaatacgctgataaagttgaaaaatgcataggaagcacactgcttaaatcccctgcaaatattatttccattgaagctaaaactgattcttttgcaagaagtccagaaagaagtgaaacagcactctgccagtttccaaatcctaatggtgcaaaaattggagcaataacattacctattgatgctaaaatactctcgttaacttcttcaaccattccattaaaattgaaattagataaaaaccatacaacaacgctcattgcaaaaattactgtaccggctttctttaaaaagcttgatgccttgtcaactgtctgtttataaacagatttaaaagtaggcattttatattcaggaacttctaaaataaatggttcttcatcttttttaaaatatgtactttttaataacattcctaataaaaatgcaactaaaactcctcctgcataaagagatcctactaccagccctctatgatttgtgaaaaatacagatgcaaaaactgtatatactggaagtcttgcattacaagacataaacggtactaaaagggccgtaagttttctatccttttcgctttcaagagttcttgctgtcattacagctggcacagtacatccaaatcctattatcattggaataaatgcctttcctgaaagtcccatttttctcataagtttatccatcataaatgctactcttgacatatatccactgtcttctaaaattgttatacatataaataatacaagaattattggaagcagtactattattccacctactcctgatactattccatccacaataagtgaactaaaccaaggcgatgaattctcaagaatatgagataaataaggaagtatggaatcattaagtacaccatcaagaaaatccgataacggctgtccaacccacgaaaaagttagttcaaacataagaaccattatccctaaaaatataggatacgcaaacactggatgaagtacatatttatcaagtttttcgcttatagtttctcttttatcttctttttcagttatgcattttttaagaacattttctataaaatcatatgcctctttttcagttttgaaataaaacttccttttatcactttcttcttttttaaaatttccttttttaagtctttcttttactttatcaacaccgattgattttccagcagttattggaataacttcaactccaaattcttcttcaagttttttataatcaatctcaataccttttgcttcacaaatatcaatcatgttaagggccagtattataggcttgtcaaattgtttaagttgtgttgtaaggtatagatttctatttaagtttgatgcatccactatatttaaaataacatcaacattttcttcttctaaatatttttttgataccttttcttcatttgaaaaagtatccatagcataaatccctggaagatcagctactttaacatcttcaaaatatccttcttttttatcaactgtaactcctggccagttcccaacatattgattagaaccagtcagttcattatacaatgttgtttttcctacattaggatttcctaacaaagcaacatttatcatatatattttcctctccatttatatatttactacaaattatgcaaaatattttacttctatttttaagttgtataagattttatatcatttaaattgattattgttatcaatttaaatataaaacactattctataactttttcaattaacactatccaatattttcaagtataatacattcagcatctttctttcttattgcaagatcaaagcctctaaaatttacaatcaccggatctcctaaaggtgcttttctcttaaattctatttgagttccttctatgcaacctaatgctgaaagtctctttgtaagttttgaatttccattaatacctgttattattcctctttgtccaggatttaaattaaaaatactcatatatttaatacctcccaaggtcccttattagcttcttatcactacatatataatacaataaaatcttgcaattgtaaatgaaaatatctatcatataactcagaatatcattcctgttaaacttatatagaaaagaactcattttacatcataattagtttcctactttgctaaaataacgtaaaataagttcttctataaattctagttaatagtattttcttgtgtcttatttacatgaatactcatctgagggtatggtatgcttatattctcctcatcaaatttaatcttaacattttcaagaagactataatacactttccaataattatctgtttctgtccatactcttgtaataaagtttactgaactatcagccagttcggaaacagcaacaaatggttctggttcattaagtataagctcttctttgtttataacgctaaatatagcgttttttacgacccttatatcttgatcgtaacccacacaaaaagtgagatcaactcgtctcatttcttgagcggtataatttcttacaattccattagctagtgtaccattaggaactaaaatttgtttattatcaacagttgacatatgagtataaaaaattcctattttgtcaaccttcccactttcacctgcaccttctatataatctcccacattaaaaggtctgataaaaagaataataacaccacctgcaaaatttgataaactttccttaagagcaagccctactgcaataccagctgaaccaagaagtgctataattccgcttgtagataatccaacataattcattatcattaaaacaagcaataactttagacatatattcataaaaccatctaaaaaagaagcaagtgtaacatctacatttcttctctccataaccttattagcagccttaattactctagttataatcttaaaacctatccatacaagcaatagtcctattacgatttttaaaccgcttgttgataaccactcataaaatttttccaaagcttgttcatatattttcattcgtacctaccaccttgtaattttttattaaaatcttaatctattatagtaggaatatggtgtttcgtccatttaaaattttttattattatatataattttgtacttttatgaattaatttacattaattctagacatattgataaaaatatatctgttaaatttcaaaattatacttttttcactatgttaacgtgaaacttttacaagaacttttttacttttgaacattctccaagagcacatcctaatctatgtccatcttctataaaaaatatagaagaatctcctggataaaaatatattttttcaataaattaaatctttaactattgtttatatatcccaaaattcctttataatggatttatatgttttatactgttttattaaaggagaaaaatcatgacaaataaaaaaacagcctatatatatctcgtcataaccctaagcctatggggaagcttatatgtagtcagtaaattcattctagataaagtaccaacctttactcttctatttctaagatatttaattgcagggatattattatttcttattatgaaaaagaaaaatacatcgtcaatagaaaagaaggactatccctatatattatttataggtgttgtaggatatttcatagcaatagccgctcaatttttgggtacaaaattctcaaatgcatcaacagcatcattaattaattcaacaaacccaatttttattatactttttgctgttttgattcttaaagaaaaatttacatacaaaaaagcaatatgtgtattgcttgcaataaccggtactgtaataatacttggtggtggtaataaaggcggtgaaataataggtattttattttcattatgttctgtaatttcatggtctgcaatgtctgtaatagtaagaaaaataactcagaaatacgattcattacaagttactgcttatggaatgttagtagctttagtttgcacacttcctttttcactatacgaactagtaatagagaaaagtaaaataatgtttaacggacaagttcttttatgtattctttacattgcaattgcatgtaccgctatctcccatgttctctggaataaaagtctttctcttattgaagcatcaagctgttctcttttttatccacttcagccaatgatctctgccttacttggatctctgctcttaggagaaataattaacttgcgttttatttccggagcattattaattatctttggaataatttacagcgtattttcagatagtcgccaaccattaactaaaaactctgttcctagcaactataactaaaaaaataaagcatactctatgtaaaggtatctttatacagaatatgctttaactctatacttatctcgtctttactattctaatcattttataatcaccaggaatttaatattaattttaattaattaagataatacatctcttacattcattaaaataaagcctaataaattgtctcctctccattttaaaggattgtctatattttcatcatcttttgccagtcctattccccatataaaatcatatccattggtttttacaagtatttttgactttgtatttataagatacttctttaatctaggattctgcgaaaacttagccatatttcctattttgacaattctatttttttctttattccatatttcttcattgaaattgtttactttacttcctattaacttcctattaacttcatctgattgggatgatatgctttaaaaattttatcaagagcttcctcatcaccaaatagtcttgccttttcagccatcatatactgttctgaacatgaatatcttatgttattcatttcaaaaggtgattgataccactgacttagacatgactttgttatattaccattatttgttttttgatgtccacaaaaaaatagaaattcgagaggctcacccttaatataaagttcctgcacctcttctttgctatacatgttttattcctcctataacacacttataaattatttgtgtcaattaaatacatggtccttcgtattacttatattatattttacagcaaattttggaaaatataaacacttaattttttcaactacaaacaacatattaattttctttttcatgtaagttttagcatgtaattcaattaatatctctttttaggtactcattattagtaattgttatacatacaaataaaaggtgccatactaagtgacaccttttatttatataaactttaattcaataatttgcaattttaaatatttattagactttcttttatgaatattcattttttaacactaccaatcaggatttggaaacatcttcattgtataatcatggatgttatcatcatcattttttctaatatcaggaccttcttcatctgtaaaaccctctatatgatcattaaaatcatattccttttcataacttgtgcttataattttatttttctcatatttttttctcatgatattatcactccttaaaaatagtcattattaaaagtatctcctcacaaattaattatattctcttgaagaatgtaaatttacttcaaaccatcgagtagatctattgtgtattgttgtatacacctttctataaaattaattaaatactactcacattaaatattcgtaaaatctattttctctcattgttatataattgctgtataataattatatataatcattagaggaggatttattttggaaaataatattatacctagatttgaaaactataactggattgatgagataagaaagtatattccttataatacacaggaggaaaaagataaagaacttattttaaaatgcataaatgattatgataatcttctttttagagaaaatccaattgctcatattacaagttcaggatacatagtaaacaaagaccgtacaaaagttcttatgatccatcataatatctacaagacttgggcttggactggaggacatgctgatggagatcctgatcttatacatgtggctataaaagaagcaattgaagaaactggagtaaaacattttcatgttgtatctgaagaaatcctttcattagatgttcttactgttgatggacatataaaaaaaggacactatgtttcaagccaccttcatttatccttggcatatcttttagaatgcaacgaaaatgataaacttatagtaaaagaagatgaaaatagtggtgtcatgtggattccaataaatgaaatagataaatattctaatgaaccttatatgattaacttatacaataaattcaatgaaaaaataaaagacaatccatcttttaaataactattcagtagttaattttttgctgctattaactttgagtaaaatttgctttattgctaatactatttaatgatatttaatatttatttaggagatgaaaaactaatggcacaaaatacaggtactgtaaaatggtatgatcgtgaaaagggttatggctttatttcatgtgatgaaggtaatgatgttttcgctcatcattcacaaattaaagataatggtccggaaaaagacttaaaagaaggtgaaagtgttactttctcaatagaagaatctgacaagggtcctatggccataaatattcaaaagctctaataaaaaaagaaatatggatgattagatttatccatatttcttaacactatattaatttattttttaaaattattttcaagattttcttcaacatatctaataaaatcatcaaatgttccatgtattattgccgttccctttgaaatcttatctgtagcaaaattatattctatgaaaccataattaaatcctggacttgatacaactatattgctatcaaaggttctataaataatctcattttccatcattctcttacagaactttaatactttttcatattctttaaagtttctctctattagttccattataaaatcaaataattcatatgcccccaaaagcggagtcattgtattatctgaaatatagaagatcttatttgatccaaagaaatatttcatattcttatatgatatagttttataatcattatttatttcaatgtcatcatttttaaatctaataactctctcaaatatgttttcccaagaaaccgaactaactgctggagtattatcttgaaatatctgcttaaatttatctactactgaatccatatttgttccagcagctacaactttatcatttatgtatactttaaataaattattttcatacattagcacaactttatttcccataatttataccgccttaatcaattaataataattattatatcatattctatattattaaacaaattttaatttatatactttggtaattgaaaattcataattcaaaatatatctgtccattctcattaattaaaaataatcttgcgtatttatttttttatattataatagagacgctcaaaccctaagcgcccctattatatcataacaagattactctataattactaccttattaagattcagattttagaagaatcctggataaccgcatcctccaccaaatcctccgccaaatccagttccaccacagcagaagaataaaataagaataatccagatccaagaacatccaccaaatccaaatccattaccataaccattgccatatccaccaccacagcaacaaggttgttgacagcagcaaggttgacattcacagcatggttgaggacagcaacatttattacaacagcagcaatcacaagatttttttgacatgtttatcaactcctattcctttgttagtatatcttattcatagaagctgatttttgttcttaaatatattttaaagattatctgcattttttgtaacaagttataaatttatattccgctacaatattactttcccaagatatataaaagcggtttgttattgaatgttattaagaagcttatttattaacttatatactacaaatgatataaatccaataattcctatatcaaaagcaagtgcctttataagattcgttccactcaaaacaccataatagtagtaatatcccattaaattatttgtataaaactctgaaagcattgttaaaataaatgatccagctccaattgaagatattataactattatcttttcatttaattttgaagtaaacatctttgtattactttcaactttaaatttcctttgtataatcaaatatataactgataatactgctatgattacaacagctacaataaactcagatataagatttcttttttgtataaatacaacatttacactatcaataaggtacgtgctttgtcctttaaagaaattaacactaatgatatcccctattttttcaagaaaactttttccatttcctcctggtatataatctaaaatcatgaatactctgctaactataaatagtaatgacacaggcaagatacttatcatacatattattcccattatagtatttgaaaacattgaatcaactataagtaaaataaatatcccaattgttccaaataaaattattttcaaagtttctattccaagtacggtaaaataaccatctattatggacataagatcataatttcttaaataagccattatacttatatatataaatacagcagtaaatattacaagactaataagcaaacatattaattcattatatttaatctgctttttagtatatggtgcgcttgttaaaaacatattgttatttctcttatttatcccctgggacatgaaatgtatcattgcaaatattatccctaaaattatataagaaaaaattgtatatgttgagtaaccattattaaaattcattgaaatatcatttgaaaccatatttatatggttctcaactaatctattacttgcaaatccccaggcaacaactccaagaagtatcatcatcttagcagaattaaaccactgatatattagccctttatttaaatatttcttcatcctattaatcctccttatcaaccttgtatatgaagatatcttccaggcttaaatctacttcttctataaaaagtggtttgaatttatttaacccttttataaattcatcgtcatactcatcagtaataattgtaaatacccttccgacttttgaaattttgaatattccttttaaatttaaatcttcttcataaactggttcatcaaaggcaatttgaatttttttaatcttatttttcatattttcaagtgaattttcatatgaaatagaaccattatctaatattgccacatcatcacatattctttcaagttcatttaaatgatgtgaacttattattattgttgtattattatcataaacttcgtctgcaaaaatctttagcaacttatttttaagaattgcatcaagtccagaagtaggttcatccaatattaaatatttagcatgaattgaaaatgcaagcattattgaaagtctcatcttcataccttttgatagttgaaatataaattttctttctggtattttgaatatctcatttaattctttaaatttcttctcatcaaattttgtatatgaatatttataaaatttaatgagatcttttactctgaaatttggatgcattatattttcatctgctacataaccaataatttctttaacctttggattgtcataaacatcttctccatcatacttaacaagtcctttagtagtttgatatattcctgtaagacatctaagaagtgttgtctttccaactccattaggaccaattatgccataaatctttccttctgggatttttaaattaatatcattaagaattgtcctgccatctatttcaaatgaaacattattaacctctatcattttcatttacccccagttccgaaaaaatctctagtactagcttcaaaaattcctcctttgaaattcctccgtagttagcttcaagtattattttttttaattccccctgaatataatccattttcttttcatccaccttccccttaaagttatctgtaacaaatgtaccctttcctctcaaggtttcaattattccatctctttcaagttctccatacgctttgcttatcgtatttggatttattgttaatatagttgacatttctcttactgaaggcagcttatcatttgatttcaatccaccttttaatatgagttcctttattccaagctctatttgttcatatataggagtactactcctaggatctattttaagcattgttttctacctcttcatgtgaatcagcttgactttcagatatattttctccacttttagcatcatcactcatattttcatgtccatcatagtgaattccttcatttgcatttatttttgaatagtcaggaggatattcactattagacatatttacaaaatcaataacatagccttcaccttcatctattaaaacaaggtctagcacttcataagaagaattgtcatattgatttttctcaatttctcctgttcttggattactataatagtacgtatttacttttaatctcactgcttcctgtttgcttattggaagccttttgctgaatctttctcgaagtttgctgtaatactttaaaagatcattttcactcttttcatctaacttcaccacttcttcaacatcaatctttgcataatgaagatccgattcagtaagtctctttctaactgaaagacattcagaaaagtcttctgtttcctttaattcaccccttgtaccatctttcattctcaagataggcttcgtttcaagtacttgtattatttcttctggactattaaaatttttctgctttttatacatcttttctgaactaactggtccaagaagcgctgtaagcagtataaagcctccaattaaaactaccaaagttgactttttcatattattccctcccaattgtattaggtgtactattcgaactagtacacctagattatattacacactttttgattatgcaatataatatttccttaatattttcttaagtacataattagtattaatattaatggattaaaatttatattaaaagttatactcaaatttgactgtattataaatttcctaaagaataaaaaccggactttatgaatccataaaatccggtttgaaaaatattaattttcttttttgtcacctatataaagaataatcaatgctattatagtaaaaactaaaggtcctgcaatcatagcaattgttgatgtataatcgccatttaaagctggttcaattatagtaaataaattagcaaatcctactgttgcagttactattattgctacaattattgcaaaggctttacttttataaacctcaaaaggtttttcaatatcatcttttttcttgaaggaaataaacgctattgataagaataaatatggtattgtcattgctacattagtcattaatacaagcatttcaaaaaatgcttttgcatttttaccacccatagcaattgctaaaaccataacaccaactattgcagtctgaaccatcatcgcatttactggcattccactttcatcaagctttgaaaatttctttggccaaagcttagctggagtaccttcaattaactgcttaagtggtgaatatgataatgtaaagaatgcacctgttaaagcaaggaacattgaaagtccaacaaatcttgcaacccagttacccatttgaacagaaactgcactactaagtcccattgaatcacctaaagtgtatccaaagttattcataactacatacgcaacatttgccatatttacattatctcctgataatgtactactccagtttgtaaatacacctacacagaatattcctaaagaataacctattgaaattattatcgctgctactgctacacccttagggaatgttttttctgcattttcagtctgatcaacaagtcctccaactgcttcaataccaccataagcaaaaattgcaaatactagaaatgaaagcattgacgttacagtttgataagcaggattaggtgaatttacaaatgacattgcactttgtactggttcagctagctgtcctttgtttaatacaagtacaattaccgcacctaaaattaaaactacatttaataaagcacatgctataccaccaacagatgttattttagttattttactcataccttttctagatattataaaaactaaaactacccaacacactccaagtattccaagactttgagttgagtttaatccaaaaaatcctaattctgatgttctatctacaccaaatatcatatttgataatggcacccatatgcttgaacagatatttatcatccaaattacatatgatgcataccacatgaataatcctacgaaagcatatttaggacctacacttttttccatccatgaatagataccacctttttcttccttaaatgcagcaccatattcagccatcataaaagcatatggaaggaagaagaaagctgctcctaatataaaccatggaattgctccataacccattaaatagaatgatcttggcatgtttgcaaaaccaaaaactgatgtgaaaatcataagaattaatgttattaaagttaatttcttttgtttttcattgtttcccattttaatttctccttacgttattcaatttttaatgcagctttttgttgttccctataatcaattattccttttgtttaattccagatttattattcccgtttttaagtaatctaataattatagtacattgtaaattttagcaaacatatcttttgaatttatttttaaaataatcaaaatttgcaaaataaaattttctttttaaagcatctgcatatatttatgtataatactattatattattgtcaaatcaagtcgtttttcatgatatatatatatttatataggttgtttaatattaattttttactttttttattttttttatactattttatcatttttcctatattcttttcattttattctcattattatataaaaattgctaaaagaacttttatatttttttcttttcttatttctgaattttctgatttttaatttattatattagaatatatatttcaaatgaaaaatcatatgaattttactttttttattacgttaaatgctaaattaaatatagcttctttcataaattttaaaattaataaaaacagaatgtatcgtcctaagctgcacatttctcaaggcacaatacattctgttctcatttttgctagtatactactttacaatttttaaatcataaattcatttttagtgttcaaaaacgactttgttttttccagttgtttttgcagtatataaatttttatctgctacatttaaagtatcttccttattatcacaagacattgcaacccctatactaagtgtgacttttacattttgttgaaatgcaattttctcaacttctactcttatcttttctgatatttcttctaattcttgtcttgacttgttagatgaaactactacaaattcctctcctccatatctgcaaagtttactatctttatcaattatttttgaaatagtattgcatacatttataagaacagtatctccaaactgatgcccatatgtatcatttaaacttttaaaattatctatatcaatcatcattatagaaaagttagtatcttcccttataaaactttcatataattcgttaaaataaaatctattataggattttgttagcccatctttctgattctgtactcttaatttttttatttttgtatatgatattaagaaaattattaaactagacactaaagttaaagataaaaccttaaaaataaatttatttttatgtttctctctttcgatagacacttctgattttaccgtttctaaaacataataagaataatcactataaataatatcttcagtattatttattaaacctgcaagttttaatatatactcttcttctagcttgtagtctttactatttatagctacattcataatctttttcattattttcctctgattgtatatatcattcttatctacacaccattgtaatatttcattatataattctatggcttctttgtaatttgttgtctgttccaagtaagttccatgtaatgaattataatttaaataaacatcactactgatattatttttattctcttttattaattcatcagccttatctaataatttcttaccttcatcaagattattttcataaaaatttttatctgctagtattaaaattcttcttatttctatatttctaaattcttcttcatcaaagtatactttatatgaagatatattttctacagtcttttttgcttcttcataatttccactttctaaatatatttcacctaaatttatgtacgcataaacatctctatatgcctcatgacttttatcttctattggcagttctagagcatcttttattaattcaactgctctatctctattttcaatttctcttaatatacgtccaagattaatcatacatcttgaaagacagtaattatcatttaaatcataagctaaataacatccttttattgcatattcagatgcttttgcataatttccatgttttatatatagttctttaagctctaaaataaaatacaatttggcttcatttgataaattcttatggctttccaaaatatctgtaccccataaaattattttactttgtcctgactctttatctgatattgtatccataagcatccatatttctttataatacttattataatttttgctgtttatattagccaaacaatatcttacaacctctgatgctttaaagaaatcgtcattagctaaatatattttagaaagaaatgtacctgcataagtttttaattttatacttgtaaagggattaacacttcttaatgatttattaagattatcttttgcttcatcatattcattatcagctatatttacacacgcttttaacagatatgccttattcaatctattatgattttgaaattcaatgatcattttatttatctcatctttgcttatgtaatcatataattctctatttctacttttcttgttatgatcatataaatcacttttaatggtttctgaggttataagtaaaacttcatcaatcttattattttttgagtttattttcatactatataaacaacctataatagttgctataattattgtaatgtaaaaatataataaaggtttctttaatgatttttttattacaatcaccatatctttctttaaaaataatttaaattagtttatccatttaaatagtttatcaaactaattacaattattttaaacccttttctatttcattgtcaattatagtcgaaaaaagtgtttgcaatacatattattacaaacacttcggataatcgacaactatatcatatatacatagtaattaaataatctacatatctatataaatacataatcatcttattattttttttatttcttctataatagtctctacacttttattatctgtgttaatttttaaagtttccattctttcatataatcttaaattatcaacactacgttttatactttcagaatcacgtatacctttagatatatctctcgctattcgctctataagtttttcctctgagcacataagagtaattttatgtacatctactccttttaatttaagactatctaagactaaattcattatttcatctgtctgtataacccagttaaatataatataatctgaaaaagaattctttataaaattatttaatataaaacttatattctcaattaccatttttttattttcttcattaaccacaaatggattcatgtaccagcagctatctccatccagccagaaagaattctcaagggatttatatagcctttcgcttacagttgtctttccaactcccatggttccatttattattatcaactttttcataattcctccacatttcaagctgttaattaatacagacttaacagactattaccatgtataattcatttttttaaaatgcagattgattataggtcattaagaatctaagtattttttctttcataatgctaaacttaatataatcattattacttagattattcttaaatcagcccatgttttataaagcttctataaattccaccctcatcatgagtctctgtaatctcatctgcaattttcttcagaccttcttttgcatttcccatagcaattcctacattacaaaacttaagcatttcagcatcattcataccatctcctagtgctatagtatcttctattctagcatttatacactttagtaaaatatctattgctgttgctttatgaacacctggaacaccaagttcaccactattttcaccaaatgcttcaactgtacatctgtaaacttcaaattcattttcaaattctttctttatttcttcaaatgtaattccatctggttcaagaaaacacgctttgttcacatcatctctgtataaatcttctcccgtaataaggccttcaataaagtgatgtggattcttttcttttctttctctagcctcaatatcattatctatatcaccataaatgcatctttcaagttgtggaataagatttttgcttgcatataaaccaccattagactcaatataaaaattcacattgtgtttattaaaaaaatctactaaatgtcttacattactatgagaaactcttttatggtaaaccatgttatcttctatttgaaggtaacctccaccagcaccaataacaccatcaaagcctatttccattataaaatcataaatttcagcttttgaacgtcctgtacataaataaaccttatgtccattttttcttgcagatctaactgcttcttttgctgattcaggaacaaaaccttcatcattacataaagtcccatctacatctaaaaaaatcaccttattattcattcaaactcctccattaactatgctttagtaattaaatcttatataatcataataaaattcataaatctcataataaaaatataacatataatttctaagattaattagaagttagaaataatgtaacagcatatctcgtactgtgatttgtttttttatataacactctgttttatataaatttattttataactcattaattatctactaaatcgacttagttaaaatacctttaatgcttatctataagtttttcatctactgtccaatttgcttgaaatgaataggcctgtaacccgtattaaatttaaattttgatcttactcctattatatattcactataaggtatataattaatcaaccaacttatagctatacttatagatgataccataaagaaatatcttaaataatatattatatgtggaccagttgcaacatataatgtaagcctgtttagtatcataacatgaataagatatgccggaaaagagtatctgcttattactgtcaatatgtttagcataatactaaacttctctgctataatgcatgaaacaagataaaaaaacaagacagacattgttctgtataaaatactcatttctatactgcttttcaaaacaggaagtccaagactatacctttcagttactgctatataaaaataaaatccaaaagtaataatataaacaacacttattaaatacttaaactttaatactttttctttgaatttcttataattgcagatagcgtaaactcctataacaaaatagaaataataaaaaataggcgatatatttacaagcttcttttccaaatcacttggatttttaaataaatgatcaattacaaatccagctataccataatgattaagtacataactatataaataagctaacaatataaatactccacttttaatatatatattttgtttcaatacttttttagtaatccacaaaattataggaaaatacaaatatatccttaaaatcattcccatataccacagatgatattgtgcatcaccagtgaatataactaaaatagactgaacatttaaagtctgtccattattaatcattataattattgaccatatgacaaatggaagaactagaaatttcagtttcttaatataaaaatcctttatatcaaatttatttatatatgtgtaaataagacttgcagcagttaaaaatataaatagttcaacacctgtttctgctcctatatatataaactttgatacaataaaattgttaaatgatatatcatctctataggaaaaacctcctattgtatgctgaagtactataaataagaatgctattcccctcataacatcaagttccagcaacctttcttttttcataatataaatctccttatttaaaaactaaacaaaatattttaagttaatattatttcttcaaatactatgactgctcatagttttcatccccttcctaaatttaacaccacttattatagcacaatctttatttttatttaacttatgtacctgtctataaaattacatttttattaataatttttaaccacctataatttcatattacatatacttttctttaacataaaataattttatccatgaactgtaaaatataacttatatatttactttttatcatattatttctaaaacattatatttttaatagtttttcacctatataaaatttagtattagcctaatattactatatcttttatacagatattttgttataataatgtaatgctttctaagaagtataaacatgtataagattatcattatttgtcaataatatactcttatagataaaatcatgaaagaggtgctttacaattaatactaattataaaactcaggaaaatgtatatattacaaaagacgttatgactgaaataaaggtcttaaagaaaaacggaagtgaactaacttgcaaaatagatacttcagacttaaatagagttaaagaattcggaccttggtttgcagaatggcacaaagattttaacaattaccttgttcaaacattagttaaaactaatgttaacggtaaagttaaatacataaaaagaagcattcagactgtagtacttgatgttaacccacaggctccaataaaacatttaaatggagatacattagataacagaaaatctaaccttgaattatataacagaactcttaaaaatgactgtgaaaaagtagatcatgaaactatggctgttattctaagagataaatttggtaacccaaaacataaagcattaatttcaatgtctgatgtaaatagagttgtaagagacggatacaactgggttgtatactataaaggttctgaaatgatggtagttgctaacactaaagatggaagaatacgtcttgatgaatacctaatgaaacctgaagaaggtgcaaaaattcatcatattaacttaaatccattagataatagaagagataatttagaaattaaagaagattaattaaaatttctaaggactatcctataaaatataaaagagcatgaaacttttttaaaaaagtaattcatgctcttttactatttaatacagtgtaaaaccataattatattttttcttacaattaagataaattaaaacttttaattattattaaaattcagtatacattttctttcttctatgagctttttatattcctcttcaagctttttatatttttcactttcaggaatacactgacttaattcacttaatacacaagtaatcctgttatcaattaaaagtttgcgctgctgtgcttcttttttttctctattatttttttcttcattgacttttgacattgaatgactttttaaattcaaatactcagtaagtccatattcataacgggttattttattattatcgaaaacaagcaacttgtcacaagtcttttccatcatatatctatcgtgtgttactaaaataagagtaccttcaaattccataagaatctcttcaagctgctctcttacatgcagatcaatatgatttgtaggttcatccataattagtatatcgcactgttgtttcatcataataagaagttttactttcattctttctccaaggcttagacaggcaacctttttatatacagattcattatgaaatccaagaagatcaagttttgttcttatctctcccatttctttgttatttttaatatcaaacaaatctattatagatatatcatcatctaaatcaataacatcttgtgaaagatatccaactttagatgactttgataaatacacttctccatcataatctatattacctaaaatggcttttataagagtagttttaccacatccattttttccaaatagccctactttttcaccttgtttaatataaaaagatgatttttcaaaaataactttgcatccatagctctttgatatttcttttacatacaatgcagtatttcctttttttacagtattatcaatgttaaaaaacacctttgattcttcttttggcttttttattccatcagtgtctatcttctcaagtctttttattctagactttatctgcttatccattctcttagcttttgctctgttgaattctttaccaccaaatttatttccagtttctatggcttttgcacgtgattctctatgagcttttcctgaccaattttttgtctgttctatctgcttgtttatctgcgttttcgtcttttcctgttcattatataaatgaagcatattttcatattcgtcaatctttacttttctataaaatgagtagttgccattatactcctgcactgatttatcatcaatttcaatgatttttgtaacacattgatctaagaaatgtctgtcatgtgaaatgattattactgcccctttaaatttttttattttatttataagatacatagatccttcataatcaagatgatttgttggctcatcaaatattagtacatcattttttccataaagcacttcatttaatgctttttttgttttttcaccaccacttagagtattgttttcatctatatttttatagtcaattgattgcttcatatatcctattttcagattgtctttatgaaaaataacctttccagaagatgactcagtaacaccacatataatattaaccaatgtagtttttcctgctccattgctacctactataccaattctttctttatcatctatgcataaatttatatcttttaaaataagattatctccatattctttattaatatttttacattcaagtaaaactgccatatattattcacctcatacatagcgaacccactttatctgttgcaaaacctaaccattatcatttattttataaacaataactaattatagctgattttaatatgtcgttgtgttttgtgtttttagtgttcatttaaatattcaaaaataataatataaataaaaaacaaaagagacctataaattaattttctcatttataaatctcttcaatcaaatttagaatatttcttaacaaaaactcaatagaaatatccatttatattttcaaaatattaaagaagaacttaaatgaaataaacagctttataaatttttgcataacaaataaaggttcactttaatttgttaattaaacatttaataaattcataaattaagctgttatcttcatttctttctcccttctaatacttatcttactttaatataaatactactcttgttaacaatacttgtcaataaaataactcctcatataaaatatattctagcataatattaaaaataataataaccatacacatttcaaagtcatataatcattaaaatgtgtatggtcatatttttacttttattcttctaaatatggattataattagaacgaataatcttatcagatatatcaagtgattttgatactatggctttttcttcctccgtaagattttcttctccttttatacttccattatttattactgcaaatgatttttctgtatttaaaagatttcttccaatacaagtttgatcatattcgtcagatggaattcctaaaagatacagtattgttggcatcatatcaatctgtccaccaaaagtttcaaatgtttttgcctttacattttgtgaaggatcgtaaataataacaggaacccttcttcctccattatcctggaaccattcctcttgatttgaaagctgtgcaatatcatcgttgtaatatttatgaattcctgtatgatctcccatgaatacaactatactattttcaagtattccttcttcatcaagtaaatccatgaacattccgatttgtttatcagtataatgcacactttctatataaccaccaagtttgttgtcattcaattctgactcaagattaagttctctatattcttcaggaatattaaatggtgcatgacttgttaatgttattgtcatagcataaaatggattctgcatttcctttatcataggaataacctgagtaaaatagcttttgtcgcttatacccattcctattgattcttcatgattaaatgaataataatctgtaaactcctggaatcctattccgccacttaaagcgatttcataattccagaaagatcctttatctggatgaattactcttgttgtatatccatttttttctaagattttaggcattgaattataattatttaaaggatatctaaagaatgttgctcctcttcttactggtaaaagtgatgtatttgctataaaatcacaatctgcacttgtaccttcattaacctgttcaaatatattagggaaatatattgatttttctactaacttatttaaattaggagttatttcttgtccatttatttcctgatttataacaaaatcctctaatgattcaacttgaacatagattagattttttccttttgcagatgcaaaatactcattatctggaagattttcatttttaaattcaaaataattgttcatttcagatttatcttgctctgtaagttcatatggccttgtattatagtatacagtaaccgcatcatgtagatgataccctattgttgatagatatctatgtgtatatgttgggtcagttcctgcgattatatatgcattttttacatacggattttttaatatgtaaatgttaaatggcacatacgctataaatataaaaggaattacaaacgtacacaaaaaaccttttacagctcttttacactctttattgaaatattttctaaatccatatgcataagctcctataattacaaagtctaaaataaacagccaatcaagtgaacttaccattgattttatactatctgacaggttgtcaagatttgatgtttgagttaaaagaaaaactgaaggtactgtattaaaccctctgtaataccatacatcgataataaataaagcagttactattatatctagtacaaaaacataaattattctcccttttcctttaaacaaaagagaaaaacttacaaatagtaatgcaaaagctatataatattccatagaaactatggatacagcagaatatcctgatgaaaaactaaaagaatatggattatcgcttgttacaaatccctgaaatacaattcccttcaatacaatagatattacaggaagtaaaaagaaaattaatcttatcatattatctttctgcatatttttttctgccaattctttgagtttcaacttaatcgtgctcaaaacctcacctcacttaatttatatgaacagcacaaacagaaattatttattttttgatttattttattaaattcatagcatcaagcaataagttatgtttagtgcctttcacattataccacttttatttttattgataaacattcttataaaaccttaatatttttataagaatatttttttagttatttttcttcaatacttcttattctcttaccattttcactatagctcatatcattaactgattctactttaagatttccattttcataaacaactttacagatacatgaattattaatttctcttatgttcaaactcttatctagataatctataatcagtcttaaaatacctccatggataactaaaagtacattacattcatctttttcactgtgagcatcacatatttcacttatggatttcatgactcttttaatagctgtttcataattttctgcttcttttgtttcatctaaaagtgcacatgtatcgcaatattctttttgaaaatcatatttttcttcggcttctttaaatgaacttacttttagataagacataatatcattaaacatgacactttcaagttcaccttcatactttccaaaatatacttcccttaatccttcaagttcttgaagctttattttttcatttgctttattttcattaatgactattgttgcagtctttacagctcttcctaagtcactactatatacagcatcaaactttatatccctaaggccaactcctgcattaattgcaacttcaattccactttctgtaagaactccatcacaccatccttgagtcctatgagctctgtttattattgtttccccatgtctcattaaatataaatttattttaccttgtttattgcatgtcattaaatcgttaacatttttatttcctaatcttttctcatgaatactcattttattcctccaacattttaaactcttctataaaatatattcttaaattatatagtttaattattcaacttcttaaaaaattcacaatcaaaccacctatttttagattctttaacatggataattatacaatatatattattaaaagttaattataatatataaatatattataattaataatttataataacctgactgtgtggttttgagttattacttattattcaatttaaaggatataatctatactacaaaaaaatggaagataactcttccatttttcatttaatttaattttttctattaaatggtttatgataaatacaatttaatatatacttaagattattctgaaaatactccttactgttactttcaattccataatagtgaaattcatcattatgcttgtatcttaatatatatattttcgttccctctttaaaattaaacttattaatttcttcaccattttttaattcactgcctataacgcatacaactgcttcatttaggaactcgttatcataggtttttaaaaacgcatataattcataattgtatccaataatttgtccatcattcacgtctgttattgcactttttacaagttcaaactcttcagctattgtatgggctacttgaaactgtgaattctttatactttctttaatgtattttatttttgaatgtatactcatattattaacaaaaaatgcttttccagccactatacataggaatactgctgcaactatccatattgcagcttcacctctctcaagaagaatatctgctgtacacaaaactgctgaaagacacataagtcctattacaattttagattttttattttcatcatactcatcaattttgctcataatcatattactgatatcttcttctactggatagaaattaagatcttcaatacagattttatttttcatttataattcactccagctattaatattaatctttatatgatagtttatttatctacaataacaactatgtattaaagtttaattatattgacaataatatttactattattattatttttccataaattcaattaatatgatattattttaatatacttaaattactaataattaatataaactattaattaattttctaatgattaagaggtgaaaatatgtctcatttagtaggcaaagatgcttataaaagtcttgaagaaagactaaataaatttccacagggtgctcctccatctgaagctctatacaaaatattatccatgatgtttacagaaaaagaagcagaacttgttgcacaacttccaattaaagcatttaatataaaaactgctgctttaatctggaaagtaaaagaaagtgaagcagaaaaaatactagacacattagcttcaaaagctcttattctcgatcttgaatgtgataaagataatgagaagaaatatcttatggctcccccaatggcaggattttttgaatttgccttaatgagaactggtggccatcttgaccaaaaagtcttaagccagctttttcatcaatacctaaatgttgaagatgactttatgaaagagcttttctttggaagcgaaacaaaaatgggccgtgcttttgtccaagaacgtgttttaaataatgataattctatagatattttagattatgaaaaagcctcacatattataaaaagcgcaaaacacataggtgtaagttcatgttactgtagacataaagctcatcatttaggagatgactgttatgcacctatggaaacatgtttaagttttgacacaacagcatatactctaacaaaacataactatgccagaaaaatagattctcatgaagctcttgatattcttaatatgtgttatgattacaatcttgtacaatgtggtgaaaatgtacaaaaacaacctaactttatgtgtaactgctgcaaatgtcactgcgaagcttttacatctgcaaaaaaattcggtcttcttgttccagtaaacactacaagctatattccttacgttgatacacataaatgcataggatgtggaaaatgtactaatatatgtcccatggaagcaataagtgtaacaactaatggaaaagataaatatgctcaggtagatgataagttatgtctcggatgtggcgtatgtgtaaagaattgtccaaaagatgcaataaaacttaaaagaagaaaagaaagcataataacaccagtaacaacagtccatagagtcgttattactgcaatagaaaaggggcaacttcaaaatcttatttttgacagtcaagctcataaaagtcataaagccatggctgcaatactggcttcaattttaaaactttcacctgtccacaaagttatggcaagcaagcagatgaaatcagtatatcttgcaaaacttcttgaaaattcttaattttaaaaagtatataatgattatttttaagagatgaggtaaaacattccacatctcttttttatataaaaaattataattcttccaagtagagtaacttgaatagatttaaaagcactggtctttattgtcgatatttaaactagataatacatttttatttatatttattgaatttcactcactttttattaaaaattaattggatttttattaaattttcatgtataattataaaaaaagtaatattacaaaagagaaaggatgcattttatgtcattaataggtattttaataattatagttgggtttgtcctaaaattggacacaatagctgtagttgtgtcagcaggagttataacaggtttggtttcaaatatgagtataactgaaatattaactacgttaggaagttcatttgtcaataatcgtactacatgtttgtttatgctcacactcccagttataggaatgtgtgaaagatatggattgaaagctaaagctatcatgcttataaaaaaagccagcggattgtctactggtatattacttagcggatatacttttataagagaagctacaatttctatgggtgttactctgggtggtcatccacaatttgtaagaccactaatacagccaatggctgaaggtgcgtctattgcaaaatatggtgaacttgatgaaaaagatattgataaaatcaaaggattctctgctgctgctgacaacattggtaatttcttcggacagaatgtatttatggctaattcaggagtattattaatcgttagtactttagaaacattaggaataagtgccgatgccctaaaaattgcacaagcttctattcctgttgctattttcgcttttattttatgcattataagaaattatatgcttgatagaagtttaaaaagaaaatataaattaaatattgaaaaaaataaataggaattgtaacggaggataaaaataatggatataaaacagatttcaaatatattattagaaattttctatacattaattggcctgtatatggcttctacaatgatatttacattaaaagataaaaaccataaaactagaattggtacttcattgttctggggaataatttctgccatattcatatttggtaaaataataccacctgttatagttggatgccttatagttgttattgcatttttatcagcattcaagcagattaatattggaactttaaaacagcttgatagtacttttacacaattaaaagccgaaaagcttggacttaaaatattcgttccatcacttgcaattgctataattgcaatgcttattgccacatttacagatttgtctggtacagttgctattggtatttcttctactattgcgcttcttttaacttttatacttacaaaagctactccaactcaatatgttgaagatagtaacagaatgtttcaatccgttggtgtattctcaatattaccacaattacttgcatcattaggtgcattatttactgctgctggagttggtgatgttatatcgggaatgatttctggagtaattcctgaaggtaatgctttagctggagtaattgcatactgcgtgggtatggcattatttactgcaataatggggaatggatttgcagcattttcagttatcactgttggtattggtgtaccatttgtttttgctcaaggaggagatcctgtagtctgctctgcccttgcattaacagcaggtttctgtggaacacttttaacaccaatggctgcaaacttcaatatgcttcctgctgctcttttagaaactagagataaaaatgtagttataaaagctcaagctccatttgcaattgcattattaataattcacattgtacttatgtacacattaggattttaattttaatataaggttattaaaaaaactaatcataaaaggagaatttacttatgaaagtattgattacaggttttgatccatttggtggagaaagtataaatccagctctagaagctgtaaaaaaactaccagataatattgctggttctgaaataattaaaattgagattccaacagtatttagaaaatcattagaaaaaattgaagaaaatataataaagcacaatcctgatatagttatatctataggtcaagctggaggaagattcggaataacacctgaaagaattgctataaatattgatgatgcaagaataccagataatgaatcaaaacaaccaattgatcttccaatatttgaggatggtgaaaatgcgtattttactactcttccaataaaggctatggttgaagaaatgaaaaaaggagaaatcccatgttctgtttctaattcagctggcacatttgtatgtaatcatgttatgtatggaatactatatatggctgctaaaaaataccctaatataaaaggtggatttattcatgttccatatataccatcacaggttctagataaacctaatatgccttgtatgtctattgatgatattacaaaaggtttagaattgtgtattaaagcatctgtttcaaacgataatgatgttaaagtaactggtggtactatctgttaataaaatatctgttcataaaatataggagatgattcacaaatgaataaaaaaattaatgtttttgtctatggaagtttaagagaaggtttctttaattatgataaataccttaaaggaaaagttatttccataaagcctggcaaaatacataacatggttatttatcatatgccttataaaggctatccagctcttttaaaaggaactggtactgtttatggagaaatcatggaaataaaccccgaaatctatgatgaaacaatgaaggccatggatgagatggaaggattcataagtgaaaacaatccacaaaatgagtatgagaaaaaacttttaaaagtagaacatctagatgataaaaaaacagaacaatgctatgtttatttttacaacaagcacatagatccaaactttagcaataaagctgtattaatccctcatggagactgggtaaatcatatgtgtgaaagtgaaaaaactagtaaaatttaataacttaacaaatttctaaattttggacttatctttgtttttatacagagataagtccattaattagttatatcttttcttataaacgtaatttattccttttatttttttaattaatcaaaaatagttctaataatcattatcttattaatgactttatccattctttagccttttgagaacattcttctctttgattttttataggatctacaaagcttatatctcctaaaaaattattttctgtaagttcattcttaaaattatcgaagcatttttccgctccgccaccaccatggcatgcaaagattgcaatattcttatactttatttcaaagttagaaagaaatgtattaaaaggcggtgcatatgtaccgcaccaaacgggagttccaattattatattcttataattgcttatatctaactgtgcatttataagttcaggcttttctttaaacataacactttttccaccccaaaagtattttcctatcttccctgtagaatactttttactaggtattaactccataatatcacattcaatttcttctgctatagactctgcaatgaacttagtgttgccctcaagactaaagtatattattaaattcttcattcatatatcactccccaaattaaataatttataaaaatattttaccatattttagggtgtgatgtctttcattaattatatttaaatagttcataaatttattattttttataaattgcatttttctaaaataacttccctaataacttcttaattaatttcacttaaaatctttctgaatccaataacagctgcaccaattgcacctgtatattgacttaagtcacttgtaaaaacttttgtatcaagatagctctcaagaatagttctaaactcctgcgaataggcaagccctccactaaaaaatatatctccattgattctaagcctctttacaaaatttccagtccttttgcatattgaatgtattattccacttgcaatatcacctctatctacatcttctgctaaaaggcttattatttcactttctgcaaaaaccgtacacatacttgatatagttactggatttctatttttcgtaaattcatcaatgttagaaatatcctcttctagaattctcatcattatttctacaaatcttcccgttccagctgcacatttatcattcattataaaatcaacaacatttaaagagttatctaatgaaatcgccttagaatcttgtcctcctatatctatgacacctcttattgaaggatttaaatatgcggcgccctgtgcatggcatgttatttctgtaactattttgtctgcttcctttaataaatttcttccatatccagtcgttactatatatttcactttttcagaatacaactcattatatattttataaatagcttcctttggttttgcagaagtctttattatcatcttctttataatattatctccatcaaacagaacgcccttggtcattgttgaccccgaatcaattcctaaagtatatactgccatttccattccccttacacgaaaatatattaaagcatttctacaaatgctgccattcttgtattaatctgccctatatcatttgtagaatagtctgtttcaacactcatatatggtttactcttttgattctttacaaatctctttattgataaagtttctatactataagtatggcatgctgttaatacaacatcaactacagcatctattttatattcatcaatcattttatcaagcatttttattctgttaggattaggcgtcatgcatgaacatccaattgataaatatttcttggaaatagcatcataaacatctggatttttttcatccacaagctcttcaactgcttttgcaacagtacaattttcaaatgcaactacataagcaccattatcttcaattgcctttacaactttttctgcagcaccgccaataggacatcccgtaatgagtatacgaggtcttgatttatatttcttttcctttttgtattcagaatcaattttttcaataagttcatctatttgatttggaatttcttccttattgaaactgaaagttgttccatttataacttttagtatatcctgtcctgttattgctataggctctctttttcccaattcataaaacttctttaacgctactctttcattgttttttatcttgatagctttccttatatcatcttcgcttatcttttcttcaaaaatttcttcaagtgttgattttaatcttattacttcacttttccaaagattaaagccttgtttgctctgagaatttggcaattccataacatgcactggtttaaactctgaaagatattcatacattttctttttcccgtcacacgttgtttccccaactatcaagtcagaaaaataaaagaacggacatttatctgttttagcaaatccataacttgacttgattaatggacaaagattacgtggaagatcctgttctgcatctccaatcgtttcatcagaggttgaacataatgaaacagttgctgcccccatggctagtgctatctcctgtggaaaatatgtacaaaacacacctatcaaaggtatgtccttatttttaagctcttttgccttaataaatgcatttcttcttccttctgcaaattcttcaaatatttctggtaaattcttttgtagttccatgattcatcccccaaattctagtagtgtctcttattctaaagtaaatattacattatctactgttgtaaatcaataaaacttatactttaaaatatacgtataaaattaattttttctcaatcaagatacatctattaccacaatatgtttatacatccctctttaatattaaatttatcgaaatatgaattttcttttggtatccactcttccttaaaccgtataagcttttcttctccatttctttttctgatattctcaatttgatcttcattatttatgtccataaatatctttaaatcatatggttgtccaaaatagggatgaagacaatacgaaccttcaattatattaagtcttttatatggtattatcacaccattttttatctttctatttgcacaattaaatattctataatttacatcttttttatatataatattatcaagtacttcttctttaaatctttcataatcaacatttccaccaacttcaataagacgtttttcagtcctttgataatcttgtaaaaaaaaatcatccatatgaaataaactgcagttaaatatgtcctttaaataatatcctaatgttgttttaccactagcacattttccatctatgcctattattattgtttctttatcttcatttatcagttttgtaatggcagttttcacaacttcaaaacgctccttacaacattttttaataattaattcatcatttgtcatatgaaatcactgctccttcagcattctgaagcttatatatcataattggaataagggtaagctgaataactattcctggaattgaatttataaatgcctgcatagcgaataatttccatgtaaagttattgccaagtaaattgtaaagtccaaaagaaactatcccccatatgcttcttcctagtatcattgcagtaatgagcgatatataaatccttccttttttattatataattttttatacattattcctgtaattaatccataagctgcaagttcaaaagacattgctattgctgtaggcattaatggtggagcaccgaataaaacacttcgcagtattggtacaattaatcctgcaataaacccccatgttcctccgcatataaatccacacaatataataggaatatgcattggacaaagcatattccctattgatggaatttgcattgtaataaacggcaaaacaatacctactgcaataaataatgctgtaaatatcatctttttagaatttttttcacgtatcttcatactatccacttctttcttttaattctctatataacgttttcaaaacatctcatatattacaatatattttatttacataataatatgacataattttaatataattcttcgaaagaactaaatttcaatattcaaatataaaaaataaccactgcaaaaacaaatttgcagtagttattttaatactttgaattatgcaacccattccccattactatttaagtaatatccattaataagttgattttccgccatttgaccattatccattagataataccatcttccatcactatctaaaaaccatcctactttcattgctccatttgtttgaagatagtaccactttccatcattatcctcaaaccaacctactttcattgcaccactatcttgtaaatagtaccagttattatccttatctttaaaccatcctacctgcatagttgaatctaaattaaagtaataccatacccctccaatatttttccatgaatttgaaattacgtttccttcttcatctttgtaataccatttaccttcattagaaatccatatattttttgttatctgatttgaattgcttgctggattatttggatttgtaatagtatttccagtatcagtaattatgctgcttgtgtcactgtcattactgctgctatgatgacttgaacctgatgatgaattggatgtttctgctttaacttcttttgtagataacttccagttatttgtacaatatggtgttataactcctttttctttaatatatgaagtcattaaacttctaacctgcccatcatctccaagtttcttagctgaactataagtcactatagacggatccgtattacttattccagcttccttcataaatccaccgccaccattgtatctgtaatcatttattgcaacagtaaatgtatcagtatcttttattaattttccattatattttaagtttactattctgcttccaactggctttgtcaaatctatatcatacgttgctccatacaattgatctaagttatagtctggaacattcaaattcggatctttaactattggatcattctcatttgtagcttgtttataatatcttgcagaatattcaagccatgtttttatctgttttccagtcattttaattccgtaaagataattttcaaaaacatatacccccataacatcctttatagttatatctccacttggtatatatgctgatgcacttaatggtgctgcaatagaaagctgagttcctgctgcattagcttgaactttatttattaaatccattattgcagttggttttgctgtttgatctttaccagaaaactcacctgttgatttacctattattgttgaagtatattttagtgttttttcttgatatggtgctattattgatacaatatctgaatcctctgctattgaagaatccatagctacattttttgtagatatactttttaccttattactatctaattgtatatctatctgtgatatattgttcccccactttcctggctcaataactggtactatcttaccatcagggttttttaagctattatcagtaaaagtagaatgtgcatgtcctgctacaattgcatcaattccagaaacttcagttgctattgctttcacttgattttcaggaattgtatctgctgcgccttcttctccactatgagctgctacaataactatatctgcaccatcatttttcataattggaacatattttttcgcctcactcacaagatcattaaaatgcaatcccttataatgctctggatcttcccagttaggaatacattttgtagtaagtccaagtattccaacttttacagtatttccatctatattaaaagattttatataatatggatttacgaaattattattattttcatcatatatatttgcagataaaatattaattccttcactcttctgactatccataaatctatttaaagtatcaagtccataattaaattcgtgatttcctagggtctctgtatcatatcccattgcacccataactttagaaattggatacggagatgttttgtctatcatattataatagtatgataatggtgttccttgtatcatatcaccattatcaattagcataacattaggattatttcctcttaaatttttaacatatgttgatactttagctaatcccatacctttagatggtgcagcattagttgaataatcaaaattcaatacattaccatgaatatctgatgttgctactattgatattgcagaatttgatgctgaaggttcattaacaattctattgttcatatttactactatcttattattttctttaacactttctaacaaagcatccctaacaagaatatacgaatcaacatatgtgctttttacatcatcaacggtaaattcagtaaaattatcaccacctgttgaaacaaaatctggtgctgcaacagtaaatacatctgtatcttttatttcactgttatctttttcccaaactatactcttaactctttcaccttcaatttcttgttttataatattaccatttgaatctttaacaggcattacataagattgctttgtattatcatattttattttaactcctgaaatctgcaatccctttccagtattatctgcaataccttgttctacaagttttttcaattgtgaaccattcatttttacagtagtaattgtattgtcaaaaggcattactttaaaaattgttcctactgtgatgtctccatcttggataggacttaatcttattccaccattatttactattcctatatcggcagcagccttattttttactacatctgccatccagtttccaagctctgactcaccaaagggttcacctttttgagtacttgtatattgaacttcatcatgtccaataacctcattaaaagtactacctatgtcatcataagcttgattaactatttctttagcttctggatctaattttgtatcagaatttacacttatagcattccaattggttcccttacttgaaaatccagtaaccttattattatcatctaatttaatttttaaatctatatagcccttccctgcattacatgcatttagaactggtatttgcttacctgttgaatcagatactacatcatcataaatactatgactgtgtcctccaaaaacagcatctacatttccatttaaatttttaacaacattatttaatggatccttgccttcatgtacaaccgctattgtcacatcagcaaggtctttttcttttatttcatctgcacacttatttatttctgaagcaagatcctttacctcataatcctttatatttgctggtaaaacaattgatgaaacatcatttaatattccacctataacagcaatttttattccatttttatttattatcttgtatgggtcatactttctttcattactatttttcttatatagatttgaacatactatagaataatttgcaccatccatagttgtattatctattgtatctaatccccaatcaaattcatggttaccaagtgttgtaacttccattcccatttctgataaaaccttttgaacaggcacacctttaagtacatttgaaactggcgtaccttgatataagtctcctccgcctattattaaagtattttcattggaggctttaacttcctttactttttctgctagtgctgcaccaatttgaagattatccttcgaatcctttaattgaccatgaaaatctgttatttctacaatatctagaacctttccatcactagttaatgtctttttaaccgcagctgatgacgtgacatctttatccattgtttcattagataataatgaattatttgctttcgtttcctcatttaaatttttactctgggcatttgcaactctaattgatccaattgatgtaaaattcaatatcattagtaagaacaccaataaaaaactaataattttatttttctttctgctcatgctaccgcctcttttacattttttaacctgtttacattttttaacaagtacgtattaattatatttgatttaatacttagtttcaattaatttcaagttaaaaattgaggcaataatatattaattattgtgtagccattgtattgcgcaatacgcatgcatagcagcacctgtaactagtatatcttcattaaaaacaactttagaattatgcattggttctccataaagagaattctctttttttgtacctgctccaagcataaaatatacacttggtacttcataagtataagacgcaaaatcttctgaacccattccgcctccttcaaaagagattacacatttttctccaattaattcttttacatatgaaccaagttcatttgctaacttagtatcattttctagtggtggtgcagaagataattctattaactgtgcttcccctctaaacatttttgctgttgaagttactatatcattcattctattaaatatgaattctcctaattctttatctaaacttcttatagttccttccataactacttcatcaggtattatattaggtgcatctccacctgcaaatttaccaattgttaatacagctggtttagttgctggaatttctctgcttataatttcttgtaaagatatatatatatgagctgcaatattaataggatcaactccagtctctggcatagctccatgacatcctcttgctttaacaataattctaaatctattgcatcctgctatactagttccaagtccatataatacaacatttgatggtgttccagagtgaacatgcatcgccatagctgcatccacattgggatttttaagtactcctgcttttatcatctttttagcacctgtaaatccttcttcatctggctgaaatacaagttttacactaccttcaatctgatcttgattttgttttaataatttagcggctcctaaaagcattgcagaatgcatatcatgaccacaggaatgcatgcatccatttgttgatttaaagtcacattcattagcttctgacataggaagtgcatccatatcagctcttaacaagaaagtttttcctggcttctttccctctatgactgctacaataccactttcgcatatttctttaggttcataaccaaactcttttaatttttctattatgtactctttagtttttggtaaagttgaaccaacctctggatttttatgaattgttcttctatattctataagttcgtctttcaatttttttgcttcattcatgaaattatccataattatacatccacctttcagaataattacatccttagatgtaactttatttaacatttctatatttagtatttactgtttttttataatgatgttattttataaaatattcatgaaattgtccacattttgtcagaataactttatgaacaattttttaataaaaaaaatactccctttataagaatggaatatatttttcctttcttatataaagggagtatactggtattttatattttaatatctatttttattaaacattgaataacatatcttcgtatgttggtaatggccagaattccttgtccactactacttcaagtttatctgcacattctcttaagttttgcatttcttcaaatacttcatatctatacataattcctaaatcatagatatcaccatcaaagttatctgctttttcaactactgcttcaagaagtccgatgttttcatttaattttactgttaaatcagaaaccttagttaataattctgattgaactaacacagaagcttgtactcctgtagcctttattgcattaattgattctgcaaggcttgaagcatatttcattgctgctggtaaaatttgacgtttagcaatttcaagagtagttaatgcttctatatttataatcttgttatagttttcaagaacaatttcataacgagcttctgcttcttttctgcttaaaactccatacttttctaaaacagctaaattcttttctgaaatcatagctttagaagcttctactgttgacttaatatttggaagtcctcttcttgctgcttcttcaacccattcgtctgagtatccgtttccgttaaatattactctcttatgatctttagcaatttcagttaatattgcttgaatttctgcatctacattagaagctttttcaagtcttcctgcaacttcatctaaagtttctgcaacgattgtgtttaatacatagttacagcaaccaattgaagctgatgatggcaccattctgaattcgaatttatttccagtgaatgcaaatggagatgttctgtttctgtctgttgcatcctttggaagatttggtaatgtattaacaccaatagttaattcacttgaagatttagaacttgtagctggtcctttttctatttgttctaatacgtcttctaattggtctccaaggaatatagaaatgatagctggtggtgcttcatttgctccaagtctgtgatcatttcctgcatttgcagcagatactcttaataaatctggatattcatcaactgcttttattactgcacataagaataaaaggaattgtttattttcatgtggtgatgttcctggttcaagtaaattcattccatcgtctgtactcattgaccagttattgtgcttacctgaaccattaactcctgcaaatggcttttcatgaagtaaacagtataatccatgtttatctgcaactttcttcataacttccattgttaactgattattatctgttgcaatgtttgttgtgctgaatattggagctaactcatgttgacctggtgcaacttcgttatgctttgttttagctgatattccaagcttccaaagttcttcatcaagatctttcatgtatgcagaaattcttggtttaattactccaaagtaatgatcttcaagttcttgtccctttgaaggttttgctccaaataatgttcttcctgttaaaatgatatccttacgagcatcatacattttcttatcgattaagaaatattcttgttctggtcctacagttgtaataactttcttagatgtagtgtttcctaaagctcttaaaacacgcatagcttgcttatttaaaacttccattgaacgtaataatggagttttcttatctaatgcttcaccattgtatgaacagaaagctgttggtatacataaagaaccatcttttataaatgctggtgatgtacaatcccatgcagtatatcctctagcttcaaaagttgctcttagtcctcctgatgggaaagaagatgcatctggttcacctttaattaattcttttcctgaaaattcaagaattactttaccgtcagcagttggatttatgaaagcatcatgcttttctgctgttattccagtcattggttggaaccagtgagtaaagtgagtagctcctttttcaactgcccagtccttcatagctgatgcaacaacatctgctacatctggctttagtgatgtaccttcctcaattgtcttttttaaagctttatatgtagcctttggaagacgttccttcattaccgcgtcattaaatacacttgtcccaaaaatttcattaacattactcattaaatagatctcctttcagttaccgttaaaatagatacttttaacacttatatattttgaattttattacattttttcaataaaattctctttaacaaaataaggagctaaagaatacttaattattctttagctccattgctaatcatattagattttttatacaataaataaaaatatgttttatgcaaatttttatataacacaaacaatatataattatgctattttacataaaatataaatatacacttttaaaatatattctgaaatatatttttcaaactcagctaccatagctttgtttatttacaaattaacaatactacattttaaaggaaatttcaatacataattcaaatatttttatatttttcgcaatatttttttcaattcattgaaaatacatgccattacctattgttttctcattaaactctagccttgtataaaaagttaatatttagataactcaatatttaaagtatttttatcacattatttctctattcatatcataagttagatacttatctaaaaattcgcttatagtttcccaatacaatttaggattaattttattagacttacaatgtcctgccccttctataataagcatctctttttcacattttgcactatcataaacctttttaagcatattgaatggaacaaatttatctttatctccgtgaataaacaacactggtattttgcattttgcaagctgatttactgacgatgcttcctttaagtcgtaccttgcacgcattttggtaataatatttgccacatacattattggaaactgaggaagcttaaacatacattttaaaatataagcaaactggtcccatacacttgtataacccgaatcttcaattgcagcttttacattattctttaaattttcaccacaagtcatcattacagtacttgctcccattgaaattccataaagaataatttcactattgttattttcattaataatataatcaatccatcctaagagatcttttctatcatgccaacccattccaatataacttccatcactttgtccatgtcccctaagatccggaataataacgttaaaccccatattataaaaatttcttgcacgtccgcacattttaatactatctccatcataaccatgtactgcaattatccatttatctgtatcataagaatttactattttataaccatgaagcttaagtccatcaaaagaatttataaatacatcactgtaatttgaatttttaaagaaccattccttatcatttttttctcttactgtttctttctgagcagattttgaattttccatattatccttacttttgaaaacagaagcttttgaagtacctgtatcaatggcaagcttgtaaaagtaatttcctccaataaccaaaacacctgtcattaacaatataagtactgtaaagaccattaaaatatttatcataaaactcattcctttcattctttattattaataactttgccttggtttcattttatcaacttaatattaaatcccatggtaaaatatgttaaaatacttttaaattattttactttataattataatataaataaagccttggatttctccaaggctaatataatctttaaattgatattaagaaatatgatattttataattatttttccatactattttccacagcattttttatactttttgccacttccacaaggacatggatcatttctccccactttattagaaactactaaattcaaaccactagtttcttttgaatcttttttcattaagtctgctggtgtccatcctttatttatccatttatgagtattgtttccaaactctacacataatttaaatagtttttcgatatcctttttattatgtatttccatccccatgtcatgtaatctcataatagcattttgtatatcaaaagtatccattacacattttatgtttatatcttcaattataccctcaacgtcttttttatattttaaatgctttaatagatattcttctaaattataataatataaagtctttttcatatagtaatcattactataatttaacagctcttccttttcaagaatacagtattccttaccttctctttcttcaagaactttatctatatcaccctcaaacatacataatgcttcacatacaagcatcccattataatttacaatttcattgttatgtaagttatatttatcaagataatacattaattcctttaaagaaagtcccttttcattctcatgttgttcattaaatatattcaagaaaaaatcaatctcaaatattccataaaaattcttaaaagctcttaaataattgaaaacttcagaatatctgctttttattaattcaattttattttcttctatattattaataactttctttatttcttctggcattatactttctatatttccatcaccaagatcatataaaaaatatagtcctatcttagcaagacctaatacttttattgactcagatacagcttcattccctttaacagaacacgtatattcttcatgttcataataagctgcaagattacttataagatgattttcatctgtcatcttctcaaaaagtttatctactaactcctgctttttcattttatatgctttatctacttcataaacttttgcaatattcttaagataatctagattcatgtaattaagattatcttttaattttgtttttattggtttttttattatatttttcatgatactgttcctcttcctttattcagttgcttagattttctatagtttattatattatatttttttataaaatcaaaaaatagcttcaaaccctgcaatcaactgatagatttccttcgttatattacaatagtaattcacctaaaaaaagctatattccatcacttatagaatatagcttagtaatcattataactattacaatgataatttaataccttgtccaccattcatttgcataatacttgttaacgtattcattacattgtcattgttcataagatttataatcttatcatttaattgtacacttacatcaccattgagcttaattttattatttttatcaaaatttagttttacagaatcttgcttttctctttctttatcagcttcatctaacataccaataagaccctttttagctcttctaattgcttctttttccgctttgctaaggggacattcaaaacgttgtccattaacaacaatccaccttttctcatcatccatacctaattcttcccaattagattctggattactagtcatataatttactatttgatcaaaagtagatctatcaacatataaagttgtatttgctgcagttcctttatctaaagttattccgccaatagcatttgtacttgatagattttttcttgatgtggaaatatctaatatgtccttaaaatccgaatatttttctacactattttttgatgaatatgtaccgttaacttcagaattcatcattgataaactatttaagtatccaccataatttcctgtaatattattaatactcatataataccttcttcctttaatattattatcttctattactatcttcgtttgaaatagattcccactttaatttttttgctacataactgctataacaaatgcttttctttcactaaatttacgtattttatctagattctccattgttcttttcctgctctatccgtacttttaattgcttctataaatttttcctgtgtagggtttccaggtacataagtccattcaaccacacttgatgccttttctgcaactttttcaagatcactttctttcattcctatttcatctaatgtaacaggaagaccgatactcttattgaattttaatattctgtcacgttcttcaatctggttatcatacgttaaaaggcataaaactccaaatgcaactatttcaccatgaagatgtttttcacattctggaatcatagatgctccataatatacacagtgagcaagtgaactattataataatagttgtccttaggatctttctgtgcttcatgggtagcaaagtttgaaactattcctgtagaaattacaatatctaatgcaacctgttctagttcaaatgaaggtgtattattcttacaatcttcaagtgcctttttaccatagttaaccaatgggtctgtacatatagatgatatacattctcccatcaatggtgtatggtacataaatttatcacggcatgcaaatttaacttcacattcctttgaaagagcatctccaatacctgcccataataatttttctggggactttgcaattatctctgtattaataaatgtatgataagctggctgctttaaataataatattctttaaatgttccatcactgttatacataacagttactgcagtacatgctgcacagtttgaagccaatgttggaaatgaaaaaaatggtttgtccaacatatctgcaagagtttttacagtatcacacgcacgtcctcctccaacaccaaaaagcatatctgcttctaaaacatcaggattcttttttagcatttcaacattttcataattagaatctccaccaaaccatatgtagtttgatatttccatatgagaatttctgattccctctattagatattccttagctttttccattgcagtcttaccaccaataactacagctttttttccatattttcttgtaacatatggaatttcattataacactcaactcctatactgtagcttggtaaaaaaacactataacttgccatttgtatctacgacctttcatatttataaattaatgattttcttcataatttaatttttaaaaataaatacctattagtatctgattatgttttattgtataacttttttgtaataatatcaattatttaccttatttaaaacaaatctactaatttaccatatccatttcatccaaatatgaacactcgtaaatcatttatattaaccaatccaataagtttattattcttagtctatccatttcaattctgtagcctataaatttaaaaagcgctaccacttttaggcaacgcttttccttttattttatttatattaacaactatgttataactaaatatatccttttcattttctactaaatcttcagctaatttatacaatttttcaagtaatcactaggtgaataagacatatattttttaaatactgaactaaaatgtttatactctccaaatccaaccatatctgatatttcataaactttataagttccttcttctagaaaggcaattgatttttgaatcctatatttatttaaaaaatcatgaaaggtctgcgatgtctctgctttaaattttctactaagataacttacgcttactccaagtttacatgatagatcttctatactaattttttcattataatttgaaacaatatactctatcattatttttgtgtatttatcgcatatataattacttttataatattccatatttataagttcaacctttttattgttatcaaaagaatttttcattttatctatcattttcttgtcttcataaaaagatttaaactttataagtgacttagttaaatattcttcatcaactggctttaatatataatcctgaacacgaaggtctatggcttcctttgcatatgaaaaatcatcgtagcttgataatataaatgtttcaaaatctactttttcttttccttttttaatcatatctattccattcattcttggcatcttaatgtcagttataactaaatccgggtttaaatttataattttttcaaggccaataactccattttccgcttcccctattactgtgcagtcacaactaacccagtcaaaagttccaattagtccttttctaataaaattttcatcctctacaattaaaactttaatcatcattattccccctaaaaacaggaattttaataagaatacaagtccctattccttccctgctatcaatttctataccatacttctctccgtaaagtaagctaatcctcttttgtacattataaagtcctatatgtgaacttttattatttttgttttttataatttcattaatttcatgaagaaggtcattacttattccatcaccattatcacttatctgaatgagcatgtccccatctttctgttcagcataaatatctataaaaaggttttctttattttgatatccatattttatactgttttcaattataggctgtattataagcttaggaattattgctttttcacaatcttcatttatatatatatcataatcaaatctctctccaaatctgagtttttgtatgtcaagataatacttaatatattctatgtctgtatttaaacatgtagaccgtgtcttattatctaagctatatctaagtattctagccatagctaaagtcactttctcacattttggatcatttgatttaatcatatatctaagcatctctaatgtgttgaatataaaatgaggattaaattgagattcaagatgttttaactgagcaagtgttgctattttcgcttcttcttcattctttttaataagttccactactttatctatcatttcattatagtattctcctaaaatctcgaactcatcaccacttgtaatattgactttcttagttaaatcaccttgctttacatattcaattccatttaaaagaatatcgatagattttgtatttttcgctgcaattttatttgctacacatatcattaccaaaaataataatccaaaaatgattccaagaaaaatttctcctgttataaagaatttatttataaatgcagtattctttattgtataaatataaatgttctcattcagtattgaattagttataacttgattctcactttcgtattccttgcttttaaatttccctgttttattaagaagaaagttatttgtatttattatattattgttatatttatccgtaattacaatgtcttcatcagcactacatgaaattatattacttaattcattttccaatatatcaaattcaataaatcctattaccctatcatgataagtaacagcttttccaatagtataaatagttcgtacattaggattaatctgtatcttgtctattcgcattattacatcttgtggatatgaattcatgtttctaaactttccccagtcataaatggacttacttttattttcgtctgactcatttactgagttagtaagtacactctctcctttaatattatatatatgaaaaatactttttatcttttttctatttatcttatcgtaaatgttttcaaaaatatttttactatcactttgtttatttaataatatgttaattgtatcttcattactgctcaattctattatatcatttttatactctgacaattcgtattctaataactgtgaaatgtattcattcatgtctctattgtctttataggaccacttggagaaactaattatgagcatattataaaatattaacgttattattgtaattggaactaaagaatataatataaaggatttttttatgacatgtttaaagctgttctttttattctgactcatattttctcctccctcaatatttatatacatattataccatttatatttgaaaaagtggctgcgccacgctttttagtttgcagttaacaattaacagttaacagttgcggtagaaaaccacaggttttctttaatttttattttcttagaaatctccttaagagatttcatcctttaactctcaactttcaattctcaactttcaactatacaaattcctaagcatgttgaatttactacattcaagcattatatcatgaatataatttcctatacattaaaaaagaatgccatgttatacagcatagcattcttttctataattaaattatggggaaactatttttaaacttatctataaacttatatctctgcttcctgttaatttgaagaaaatcaaaagagatattattgtagtaaatgtcaatattgatgaaagtgctgctgctgttccgtaacttgcccttattacttctgaatatattgctacagacatagttcttgtagttcctgtatatagtattattgaagcactcaattcatttataactgtaatccagcttaatattgctcctgatattacccctgggagcatcattctagatgtgacatttttaaatgtctgaaactgagaataacctaaacttattgatgcttcttccatgcttggacttatctgatacaaaattgctgcacttgatcttatagtatatggaagtcttcttattacaaatgcaattactataatcataaatgtaccgcttaaaagaataggcttcttattaaatgcaagcagtaatgttatacctagtacagatcctggtattatataaggaaacattgtcaaagtatctaggattgaagtaaataaatttttccttcttactgatacataggatataaacattccaagtataattattaatattatggctattattccatatacaaatgtattcctaattgaacttccaagctttcctattacatttatatatgaattcaatgaaaattctcttatgaacatggctccttttgtctttaagaaagatgtaaatattactgtaacttgtggtataattgctaatcccacaactatatatacaaatgtgtgtgccaaaaaactctttattccatttatctttttaggctgtataggctttaatgaactcattacaaaggattttttatttacaacatatttttgtccaaggaaaattatagttgttataaataccattattgcacttaaagctgctgcaaagtttgcctgtcctcctacctcacttatgaactcagagtatattaatacaggcattacttggtatccttctcctataagcattggtgtaccaaaatcagctaacgcattcataaatactaataagcttcctgcaagtactgttggtaaaattaatggaattactactgtaaataccttctttacacctgtacatcctaaactttcagatgcttcaataagagaaacatcaagttttttcaatgctcctgttgtgtacatatatataaaaggaaataatttcaatgtgaatactaataatattcctgaaaaaccatatatgctcggtaagttaattccaaatgtatctgagaggaaagttgttataacgccacttcttccaagaagtaaaatccaagaataagctccgatgaaaggaggtgaaagaactgatattataattaaaatttctattaaccctttcccctttatcttacatgtagtcattacatatgctaagggaacacctattactattgttaatattgtagtgattattgtaactgaaaaacttctccatagactttcgtagtaatattttttagtaaagaactgtacaaaattgcttaaagtaaactcacctgtatttgaatcttttaaactgctaaagaataaagaaaatagaggatatatcaaacatactgcaaatattagaaatattcctatagttacaacattccagaaatccagcttaaactttttacattttgatgcttccataagttacacctcacttatcaaaagatttttagatccatcttcattgtatatattgatttttttggtgttaactttaagatagactatatcaccattttcgtaaactttatcattattgctcaaatcatgtgataattctattttcattccatcttctaattggactacataatccatatactttcctaaaaatgttgcagtaataattttaccttttaaaccttcatcaccgtcacctattataaattcctcaggccttacagtaactttagttttcttctttaaatttccatcacataatatatcaacatttactgtataaccattatcaaactctatataagactttccatttaacgatattagtgatgtatcaaatatatttgatcttccaataaaagttgcaacaaaaacatttcttggtcttgaataaatattgtaaggtgtgtcaatctgctgtatgacaccttccttcatgattgctatcctatcagaaattgcaagtgcttcttcctgatcatgtgttacataaactgttgttatgccaacctgcttttggatatttcttattgctgatctcatttcaattctaagttttgcatcaaggtttgataaaggttcatccataagtaatacatctggatggataactattgcccttgcaagtgccactctctgctgctgtcctccagacaggttttctggaagcctgtctttatattgtgttattttaactacatcaagaatctcctcaacccttttctccatttcctctttagatatttttcttaactttagaccatattttatattttcttttactgtcatatgaggaaatatagcataattttgaaacaccatacctatatttctcttatgtgcaggaatatcatttattacattgtcatcaaatgatatagtcccaccttctattgagttaaatcctgctatcattctaagcaatgttgtctttccacatcctgatggtcctaatagtgtaaataattctccattttttatatctgcctttaaatctggaattactgtattttctccatatttctttatcacatcatttatattaattgatttactcaatcttcccacctccgcttttatgtaaataaaatcgttttctttaataactcagattaactattgtaaaattaagaatatagatcttaattaacctatattcttaaaatttattttcttatatcagtattttcaattatatatgctgcaataattattctgcatataattttaaaaatcctgtaaggattttcaattctcaactatcaattgtcaattgaaatatatctattagttgcttgtgaatatatctttatacttgtctaacattgtctgcttgttttcattaacccagttttcatcatccttaataacttttatactattaaatgattctaaaccttcaccttccacatcgtttctaactgaacgtctgttaagctgtgttgctactacattctgtgcttctttgcttgtaacaaaatcaatgaatttctttgcattgtccatatttttagcatttttaataattgaaacaccgtcagcttttgcaacagttccttctgaagggtaaacaacttttactggtgcaccgtcttttgcatatttaacagcagcttcttcaaatgtcaatccaacagtgtattcaccatcagctactcctttatatactgctgatgatccgcttagtaattttccatcaagattttttgtaagattagttacataagcccatccatcatctggatttccatttcccatagcatataactgattgattaaatgttcaaatgctgaagatgacttagaaggatctgcatttgctatttttccttttaattcaggatttaaaagatcttcaaaaccttcaacttttatgtttcctattaaatttgtatttaccattataacgctaggtattacagaaaatcttgttatatgcccatctttatttttatattcatcaattactgcatcttcatttgctgatttatattcttcaaatagatctgcttttggctgtaatgtggataatgaacctccccacataacatctccaagaggattatccccttcagattctattctttttaataattctcctgatcctgctgtaacaacttcaactgatactccactttggttttcaaattcatttactattggatctataaattctattggatgaggacaatacactattaaattttttgaagaacctcctgatgcactgtcactagaattacttgctgctgatccacagcctccaaaagtcatcaatgttgccactgataaaaacattgctataagcttctttttcatttaaaattccccctcatttttaaatatatttttctataatcgtagcttgttatttattatctcccttgtgtacaattacattttacctttgaaaacgtttttaagaaacctaattttcggtacttatatccttaaatttgaagtttatttttatggatatatcttaatttttgaatagtatacattataattaacattgactttcaaatttttataggatattaactatcaaaagtataattaaatatataaaaaagccaatgtaagattttacgcttacattgacatttcaaattactataattcaatattattattcttattccttcttttccaaataattttatgtgtaatcataaatataaatgtaaaaatcaaaattagaattacaaatgttattcctattaaaaaattcaaagtgcatatctgctgtgcttgatttgtataaattcttaacactgcttcagtatatttccctaacataggaatggtaaatagtaaaattaatagctcaaataatttttaaaatacaaaactacaggctaagaatataaaaatttaactaatatattaggtactaccatagatactgctactgcgtaaactgcatcaagccagacaactgatccaaaagcacctatataaattgcaataataaatggaaaagtaacaactttgaatagaaaattaacattctcattttttaatacagatgcaattaatgcctctgcatcaccagtgctaggaaatgcatgcattagtattgatattcctagccatcctaataaaagagtaaggaagtttccttgttcacgaaatttaattaatgtaatagatgctggcaacattataattgcacctaaaattgtattaactaaaaaaggcccaactgatattaataatgatttcaacggtttatctgtaggttcatgcactacatatccacacggatttgaacattgaaaaaattttgcatcatatattggtattcgtagtaatttgcaaaaaatagcatgtgctaattcatgtactattactcctggaaatgtaataactgaaattaatatacctggtacaaaaaacatatatttttcctcctatccttgataatattgattaagcgttaactggccgcttaataacatttttgtatctccttctaattcatttccagccgctttaaattcttctattatcttatttgattcttctacttgtccatcaaaaaataatgcaatggctaaagtttcgtatacatatggatattctttgcttttttcatatgcaaatctagctagttcaacagcttcactataattcccttcaaccatatttaaaatagcaagtccccttttagctcctatattatttctttcttttataagaactttatctaacatactttttgcttcatcactattaccttcacgcctatatgcatttgcaagttgtacctgtgtttctaataccttagaatcttcttctatacttttctttaaatactctttatgttcttcagcatcatctgtaagtaacgctaagtaattatatactacagccttgttatatttaccatcatataaaagtttgcttacatcactctttgcttgtaatactgcttgatcttcagataaatttgtatcaatatttgatacaatattctcgtactcatcatacacattataaattgaatcaattttatttaaataaccatccaatctataatagactgtatctgaaactttttttccaactaaatatgtatccagcagataccctgcatatgcataattcccattctccattgcaatatctactgctgtaacagcaatatcagttgtctctggatgctttccaattacaccttctaatgatagtaatgtttcatttgcatagccatcatttgccttctcttcagctgttttatatactgcataatctttaaaagatttaggaaactgtactagtgcaattattacaagtacagaaagtgctattcctaacagtaagaaaattttaggaatagggtattttatctgattttctctgcactctgtacacaaaattgaatatctgctttcagagacatcaatatattttgctccacacctttcacatattttcccactataatttacgttttcttcaaaatcttctactcttgcgtttccatcttctagcattaaacatccccttattgtctttaatcccctaatttagtattatatattataatttacataaaaatacaagctttaccattatacactattaaactctataatatcaagatttattatttataaaataagtaaggagttagttcattcctaacttcttactttcttcagttgcaaattcttctataatttcatataagataaggagtatatgatcattgtaatatttcatgttttctttatggccatttattttaattaagaaagtattatcacttttaagaatactcttaatacatttttctttactgtttaataacatcagcacttgtaaatctctgatattcaccaatccagttaagtttattggttttagtctgtccatttctattctttgcagtaattatttccgctataatatcatcagtttttttattatactcaacatcttttcgcatattattttcattgttattattaatatttaaatttctactattatcagctgtacttttattaacagatgttgatgctgaattgtttattttaaattctccttgaattccctcagaatcttttttcttgccctttttctttttattgttattgtaatatgcatctctatatataaaatggataatatcagcatcctgttcaatagaacctgattccctaaggtcagaaagcattggtctatgatcatttcgtgcttcaggtgctctagaaagctgtgacaatgctattactgtaatattaagttcttttgcaagtgatttcagctcttttgatatatatgatacttcttgttccctttgatttgccttcattgttgttcttatgagctgtaaatagtctattactataacatcaagacctttttgcagcttttgttttctgcatagagcttttatatctgaaagcatggtgcttttatcatctatatataagttcctttttccaagttcacttgttcttttcattatccttacaaattgatcatcagtaagagtaccactttgtatatcattcatttttatcatacagcttgaacttatcattctgtttaaaagactttcagtttccatttcaagtgaaaatattattacagaacttgtccttgatgcactttgagcaatattaagtgcaaatgcagtcttccccatggatggtcttgctgccacaattacgaattcaccaggtttaaggcctccagtaatatcatcaattcctttaaatcctgtacttattccaacaagtcctcctccgtttttgcatcttttttcaagttttacaaaggccttttccagtattgtgtctattctttcaggaccagtgatatttttacttgctgaaacattgaaaatacacttttctgcatcttcaattgcctcttttacatcttctttttcaaaagcatcctccatgagttttgatccagtttttacaagtgcacgtctgtctgacttttctttcacaattcttgcgtaattttcaatgctgctgtaattcactgcaccagtttcaagatttgaaaggtatgtaataccaccgcattcttcaaggattcctttctttttaagattatcaactactgttactgtatcaacactaacagaattatcacaaagttttttaatagtttcataaattttcttatgtttatctacataaaaatcttcagaatttaatatagtatcagcttctataaacctatctgtactgtttaaaatacatcctataagagtttgttctgcttcaagactgcttggcattactctattattcatattacaaatcctccagaagttctgtatttattataatttcactttcatataaatcattgtcttcatcatcttttgaagcttcataactttcatgtttttccatatgatcgcaatagcctatccaatcctttgaacctgatttaacagctgagtctctattgtaatttccttcaagtacttttatataattattttctttaataatccagtcaaaactacagttcatccactttccatttcttccagaaagataatcacttttttcagccatttcaaagattgccttaatctcatcaatatgaagatttttatacattttctttatattattatcacgtgtcttatttctcactttaacttttgggaaggatctgcataagtcattaaacatattaataacctcatcataaggaacccctgctttacaattaacttgtaatttttgtttctcactttgtatccctgcctgtgtaatgtcacatgcagaatgattattatttatagatttattaatagaataatcttttgctcctactttccagtctgaatcctccgacttttgactaattgactccttcttttcagtaataccctcagtcttttcagtcagtccttcatttatttcagaaacctcttttaattttatgtccactatttcattttcttcaatattatttccagcagtagttccataagtatcttcactatcttcacattctgatgcatcatcatataaaagaagatcttgatagttttctccaattgcataaaaagcataacttccaccttctaaaacatgttcatgcatgagtattttacatgaagtcatttttttgagacgtcttcttaaaacatctacgttgtttattctcaatataggaagctgctctaaaagcgctgagcctttcagccagtaatatggaactttatttattattttcatcttcatttttccactgtctttaaaatctataaaataccttaatataagtgcatctttttcatctaatccataatcaataaggctcttttgtgaaaatccttctactgtatacttcataatataaccctccatacatttcagtaatatctacttttaagtagttctacataatatatatgtttattgagtaaaaagtggaaaaatttttatgttttttatgaaattatttttttattcttttagatttgatgtatatataaaaattatctaattaattttaaaaagcgttgcctttttggcaacgcttctacaaaacattaaactcatttaattatgatacacaccacttagtgtaaacttctccaaaatatggtcttccatttcatgatatagttcatttaataaaaaccattttgtaaatctaataatttatctaaagcaaacacatgaagttcataaagatgtggcttatctagatgtgtcataacaaactatagtttgacaatacattttgttttttaataattctctcaaaaagtgctacaaaatagctcttttaaacaaaaaatattccatgctatattcctaacttttataacacatttttcaatacaatgtttttaatatgaataattaacctgttatataaaaaagagaacctgaattttcaagttctcgatataactaagtatttattacttaatagattgagcgaatatcttaacttactaaaaatattcttaaaataaatatttattaaataaaaaacataagctatttacatttcttacaagctgtatatcctttattaatggcttcatctatactcattgctgtactattcttcattccatgagctgttgatgtactatgatatattccattatttgaaacataaacagtatctgatactgaatttgttccactatttgaagttatagttgatgtactagttggaacctctgttgtccatgctccacttgaatttaaataataatttcctatccaacagtcatgagccatatatccatccgaatagaaataataccaattcccattaatatttctccatcctgtagcccatgaacttccctcagtgtaccaccatcctgtagtgttacttttccattctgcattagctgcaattggattaattgcaatcaatgataaaaccgcaataaagctagctaataatcttttaaagttattcattattatccccctatttactatatttttcttgtataaacaaattatactttcattcgtctattcttgtcaattatttaatattatttaataaaaaacaatatttttgtataattatattttaaaaggtatattattaataaatatttatttattttttaacttctttaaatttttttatatttttatcaaattattttttcgtctctcagattatatataattaattttaaaaagcgctacctttaggcaacgcttctatatataattagcttccattttcctttaatcatatcatgtaccagttctacaggacatgtgtactcttctcttattttcatttttcctccatgtgattaaaatctttacactaacttcttaacttatttaataaatgcttttatatattctctagctttctcttcaattaatttttgatatgtgtcaaatgacatttcatttaaagtacatcttcttggtgtgaactcttttggtattcttttattttcatatgtattaatccattttacacatattgcatgtctataatcatctttcgtattgcctaaaaatctgtatacctccgaggtgacaattccaattgcctttatatatgttatacctttccttgcaattataatatctccttctttaatttttaatatcatatttatttgattaaattgataattaactcctaatttatttttatattgaggattatttttatctatcaaattccataaatcacgattaatattaatatttttaaaattgtctattcctttccattcagtacgtacgtaattgttatttaaacaatccttccaaaattcagttagttctttgcctctcttgtcacttatagcaaattcatatattttcactctgtagcctccccttattaaataaaacctttttcatataataccattttgtcaataattataaaaactctaaattaacacattagaacttttgttctcctatttatccaaaaaatctttactttaacctacgtaagtaatataataaatacgtacgtttatacgtacgtaggaggtacattatgaaaaataatttcttttatacatttccagcaattaaaggaaaacaggcaactagggactacttcataataatgtgtccactaaatatattatcaaaattatttatatttaatgaagatgaactgccacctgaacatagagcacaaagaattttgaataaagctcgtattccagagatggctacatatatagttaataaccctaaagactatgtattttcatcattaacagcatcaattgatggtgactttgaattttctgcaattaatgcagaatttgatgataaaataggtaatcttaaagtatctatggacagccgattacttataaatgatggtcagcacagaagagctgctatcgaagaagctattaaagctgtgcctgaattagaagatgaaactatatccgttgttttatttatagatgaaggtttaaaacgtagtcaacagatatttgcagatttaaataagcatgctgtaaatgtctctaaatcaataggaattttatatgattcaagagatccaattgcaatgattacaaaatcattacttgaagagaataactacttaaaacactttactgataaagaaaatccatctttatcaaagttttctccaaagttattcactttaagcagtataaatgaaactaataaaaaattattaaataaactaaataccaatgatcctaaagttattaattttgtaaaagaattttgggatgtattatgtgaaaatatgaaagaatggcaatttgtttttaataaagaaacaagtgctgctcattttagaactgattatataagttctaatggtgttgttctcgaggctttaggcttagtaggtaatcacttatataagaataatccttatgattggaaaaaaatactttctaatataaagcatatagactggcacagaacaaatttagatgattggcagaacagagtaattggacctactggaagaatagttaaaagtgctacatatgttagattaacaaataatttaataaagattaaacttggcatttctttgagtaaggatgaaataaaattagaaaatgattgtaggaaggaagactaaagatgaatgcagatctacaaattaaaatagatgacatacttgaagaaatgaaaatggtatacaaaaatgataaaaggccatgggttataggttatagtggtggtaaagatagcactgctgtagtccaactggtatttacaatgcttcaaaacttacctaaagctgaaagacataaagatgtctttattgtttcttctgatacattaattgaaaatcctattgttttaggatacttaaaacataactcacaattaataaatgaaggtgcaagaaatgctgatattccattatatacgcacatggttcatccagactatgacaatacatattggactaatataattggtaaaggcttgcctactcctacttctattagattcagatggtgtacagaacgtttgaaaataaaaccatctaacacattcatagaaaataaggtcaaagaaaatggtgaagttgttgtacttctcggtgttagaaaaactgaaagtattgccagaggtataagaattaaaagaagagaaattgatggatatctattaactccacatgttactttagacaatacttatgtatataatcctattgtagaattgactactgatgatgtatgggaagtattactttcaaataatggaattacaccttggggtactagcaataatgatttatttgctttatatgcaggtggcgatggcggagaatgtccatttactactactaacgataaagaaaccccttcttgtggtaattcaagatttggttgctggatatgtactgtagttaataaagataaatcattaactggtttcataaaaagtggtgaatcatggttacagccactacttgattttagagaatggattataagtataagaaatagacatgaatatagaatgcaatatagaagagatggaaatcattattataaaaaattatatattgataagttgcctttactagacaactacactattgatcctgattatctttttgctaatgaaaatggtgaaggatatatcgatttaaaaaactgccagtctgaaatggataaaggtaatgtttcgccttcagatgataaggataaaatttacttagatttattaccacttttaagtgtaaacaatactaatgatattaaactagatgaatctaagattcaaaaagatgaaaaaggtacttttgtaaatgtgcttggatacggtccttttaacttcaaaggtagaaaattaattctaaaaaaactattagaaatacaaaagcttataaatgaagaatatgaaattgagcttattacaaaagaagaacttgaagttattgatagaatctgggatgaagaagaagatttaactcgtagatcattagtagacttatattatgaagtaactaatgaaagacttccttgggatgattataaaaaaccaatgtttgataaaacaacaagagatgaaatcgaaaaattatgcaccactcttgatattgatcagggattaattaataaacttttaattgaaactaataaatataagcattttacaaataaaagtgttttagataagtctattaataaaattcttaatgcaagacatttacacaaagaaattgttgaggagatagaaaatgataattaacagcataacattaaaaaactttagatcatacgaagatgaaactaccttctcctttactcctaaagataataaaaatattgttcttataggtggtgaaaatggtgctggtaaatcaactctatttgaagctattaaattatgtatttatggtcctattacttatggatatcttggagaaaatcataattacctaactaagattaaaaataatataaatgataatgcatttaaaaatgaaaatatagaatgttctttgggattaagtatttctttcaaggaaggtacacaaattaaaaactactatttaaagcgctcttggaattatattaatcaaaagatacatgaaaattttaaggtatatttatatgataaagaattaagtaatgaagataaattatattttgataaatatttaaaatctgtactaccaccatcattatttgatttcttcttctttgatggtgaagaattaagtgatttctttactggtaaaagtgccaatgctaatttaagagaatcaatacttgaattgtttaattacgatacatttgaagtactaaaaaagcaattattaagtcaccaacgatctaagactaaatcaaatgctcaattagaagaaactcaaaataattttgatttactctcttctactgttaaaaatataaagaatgaaattgaagatctacaaaaaactttgattttagatgaagagcaacttgataatcttcatttaaaaagagatcatattgaagatgactttaaaaatagtggaggacttttagaaggtgaaaaagctgccctaaactctgaaattgcaaaactagaaaatgaccgaattaatctaaatacttatattaaggatttttgtaatgatactttaccatttttattagtaaaagaccttttaaaagacacaaaacttcaaatagaaaaagaagatgcattaaattcatacaatgccataagcaaaaaattatctggaaatgttataaaagatgcatttattaaacaccttccagctaaagttgatagtattaactttaatgaagttgctgtagatcttcttaataatatgtttaattcaaatgaaatgaataatatagataacattttggagctatctatagaacaaaaaaatactataaatcatattattgataatattttaaataatcaaacttcattctcgaaatctatttttgataaatttaatagcatttcagatattggaactaaattaaaaaaattgagagacaaattaaattcatctatttcagctgatattttaaataattacttagaaaatcttcattcgattaacgaagaaattaattcagtactaaaaaatattgctgttagaaaatcggcaattgattctaaaagtgaagatctaaaaaataaagaatatcatcttacaagagcaagaaatgagtacacttccctacttcaaaatataaatgttttagatatgtctactcagcttataaactatttaaataaacttcttacaaatttaactaaagataaaatcaaattaatcgaagatgaatttataaaaatatttagtattataattagaaaaaataattatgtaaatagtattgttattgatgaaaatttcaacaccacactttacataaataaagattataacagtactgaaatattaaatgtaattaacaacatcggttttgatggtttagacaaaaagtatggtcataagttcttagaagatttattaaaccattataatgttgataacaacaaagatttaaaaaaggctgtagctaaagatatttcatttaattatataaacttaagtactaaaattaatatcaatgacttctcaaatggagaaaaacaaatttatattctatgtttaatttgggctattattaaaagctcaggtgttgaaattccatttataatagatactccttatgctagaatagatgaaactcatagaaattcattaactactacttacctaccaaacataagtaagcaagtaataatactttctacaaataaagaaatcgatactgaattatatgaggttgttaagccttatgtatgtgatgaatacttacttctatataatactcagttacgtaaaacagaagttaagaatggatattttgaggtgtaattatgggatttagattaaaaacatcaaagaaaacaaaagaaatatttgaagaagtaggtaaaagtacaaatcttaagccatttgccttaagtaaaattgctgtatccttatcattaaaagaagaaacttcaattgatgaatatgaaagtaatgatactaacggacttgaacttcaaagagcaacagttacaggtgactttgattcaattttcaaagctcttattgaggtaaagcttggacgtaatataaatgatgatgaatattatccatactatatgaaactgcatatggatagaggtgcagaacttctagcaaatcaatacaaatatagtggtggtaatttagaaaaattcttaaagaatgcattaaaagagggagatgctaatttatgatttatttagataatagcgctactacacctattgatcctgaagttttagatgcaatgttgccatatttaaaagaggaatatggcaacccctctagcagatattattcacttgctgttaatgcttataatgcagttgaaaaagcaagagaacaagttgcagcattaattaatgcacagcctaaagaaataatatttactggaggagcttctgaaagtaataacttcataattaaaggtgtagctgattataagaaatattacgaagaaagtggaaatcatattataacttctactgttgaacataaatctgtgttacaaacatgtaaattcttaaatggagatgtattttggaacaaatcagataaatcagttgcaaatcagtttttgaagaaaaagtctgctactaagaaaattgatcgtggatatgaagtttcttttcttcctgtaaatagctatgctcaagttgaagacgatacttttagaaatgctataaaagataacacaatacttgcttcatttatatggggtaataatgaaattggatctttgaataatatagaaagcttatgtaacatagcaaaagaaagaaatatactcttccactctgatgcaactcagattttaggtaagatagatattgatgtaaaaaaacttcctgtagattttctttcaatgtctgcacataagatttatggacctaaaggtgtaggtgctgcttttgtaagacaaactggattaactaattataaaatgacttcactaattcatggtggtttacaagaagatggttatagagctggtacttctgctgtccataatatcgtaggcttcggtaaggcttgtgaaattgctaaaagagatatgaatgaatatattaagaaaatatctgcaatggaaattgaatctaagaaaatgcttacagaaaaatatcctggagttgaatttttaggtgatccacagcatcatattcctggtgttattggaattcttattcctggtattgtcaatgatatgtttattaaagatatggcagataaaggtgtttgtgctatttcttctggttctgcttgtgggattggtgaaccttcttatgttattcaaaatattaaacttaataataaaagttcaagctttctaagattaactttttcaaaatatactgatataaatagcttaaaatcaaatattatttaactatttaataaaaatactttaaaataaaacgtaaatttaaaaattccttgtctattgaaaatgtcagaatatttatgtaattagaatatccataacttaatataactggaaatcaacttccagttatattttttaatcctattatttatataatatcaagattttgtatttatgaatattaacggtaaccttatcttgattacttctttttattaaagcttatgaaaattttaccttgtaattcatttttgttaatccaaaaaataattttttcatctatatctaaaagagttgcttcttcactactgactttctttaaaaattcaattatattattatcaatatctaatgcttctattatctcgtttgcttcttttatccccatacataaagaattaagctttttattcacaacagcccaattagcacattctttaattttattagaagcatatttcactttatctttatcttgtgcaattccacgtatagcatctaataaatttagtatcctcgtagttttattgttgtaaaattttttccattcatcttctaataattcattgaattttctgttctgagtttttagattattaattgtataggcatcaatggaattatcttttaaaacttttcttattatatttaatattgttttttcaatacttttagcttcctcagatatttcaaattggatgttatcaaatgccgaagaaataattcttagattataattattatctgcaaccatactcttaaaactactgtctaaagcattctgacgttgtatatcacgtttatttttttccaattcaaccatatcctgcatttctttgttgcattctttaagtattttactaagcattattacccctccatctttgctaagatttcttcattctcttttagcaatgctttttcatcagaatatcttttattgcttaccccactattattaattgataaattttcacttcttcttttaatttcattttgtactattcttacatctgaatctactttgtctaataatgtagttaacgtttcaagatgctttataggatcctttgaaaaaagcattaaactttcaatagtattttttttagtctttacttctgaaatagtttctatggctttttcaattaatattgcatcatttttcactttctcaataattatatcatcatatttaatatttatctgagctttattagcttcatcataaaagtctataatatcatctaccaaatcatttatatcatcttcataaatttcctctttatcaaaataaccatttattttattaatgtatttatctgctttttctttttctgaagaattaacttgatcaacacgctcaatgatttttaacaaatattctctggaatctcttctaagtttaacaggatcactttttttaagtacttctttatctacttttaatttattatttaatattctagatacttctttctcaaattcagcataatctaagaatacctgagatgatttttgaatgccctgaattaaattgtaataattaataatattatttttatttgtcttatcattttcatcctttatcataatattcaataaagcattccattgattactatgtgaattagtcataggtttttctatattatcttctaataataatcgattatcaaatttcttcaaatcattttctttataaattccaaataatattaatctgtatatttctgaaattatagagcagctataataatcaataggataattatcgaatgatattagcttctttattaactcatctttaatcttttctgtccaaagctgtaccctataaagcatcactggtgcgtcttcaaaattccatgatccttttccaagaatatcccatgctaaaaatgcttcaataatactttgagtttcacggtctgctggtaacattacaaacattaagtcctgtccttgtttttgcctttcaaatccaataagactattcttaccattcttaattttatttatgttatccatagaaattccttcatactgccaattaattgcagaataaagataagaacacataatatctttaatttttctaaaacttcttccattagagagtgttgaactagtttctatagttccaccatctatccaattttctaatgcttgcaaagctgctttatacttttcctcagcttcatttttttcttttaccttaactgcatttttttctactgcagcagatttcgatacaggcgttgttggatttgctttagtatttgattttgatttatctgcaatattatcatttacataaatttttattccatctattactggaagatttaattctttatatatattttggggaatatccgaaatacatttaacaccatcatttatcgtttcatatgcacttgcatttccccatatgcacataaaatttataagtctttcaaatttatcatcatttacacgctgtcttacatattctctatgtgcaattggattcattaatggaatattttctattttaaatcctgggaaatttgatttattatataatgcatctcgtactgttctttcaataacatctcttagcaaatatctaggtgttctataatctggttgtaacactttattatataattttattattgcatttttagtaaatggatataggttaagcttcttaccttcagatatctctatataatcccatccttctccttcaatcatttcatgtacaggataatcttttttatctccaccactatttatccattcatcaattttatcactttcaagtgacattacatttaaatatctaccaacaaattcaaataattcttcttcatcttctccaaatatatcatttggtatataaagaaattcagtcaccctgtctttatggttatcttggaatttatttttataatagacttctgttgttcctattattgatgatattctacatagattttcatcaatatacatacctgtatgttctgttgttaaaacatttaacaatgctacattaactccagtaaatgcggtaatatcttctattaacaatgtaagatttttaccttgtctttttatttcttttcttatttccttaaagacttgttcaaaatctccaggttcaagaccagtacaagtttgaataactttatcaaccaatgtattcatataatcagccaattttgctggcatatctgaatcagcagaaattattgttaccattttacatgcattcttatcagcatttatcataatttcatcccagaacttaccttcggctataaaatcctctttttcaaatgatgctataatatctctattatcaattgcggtattttctgctatctttgcatatattctttcaatcgggccgtcatctctaagcattttagattgaaatacatcattttgaagcaatgatacaagtcttttctgctgaatattagtaagtaactcgtgattatcatcatttaatatctccactataaaattctgataaatcatatcttttaattttttttcactaattgctgtatttgcacgtactagcctatcatagacttccttattaggaatattagcaacttcatcaagatctagcaattgtttaattgtaccctttaaagtattgtcacttcttcttacaaataaaactacttcttcttcatttgatacctgtcttaatttggcatcaaaccatctaattaaatgagattttccagcaccacttgaaccaattacaagaacaaactgatgcttgttagaaggattcgctacaattttgttatatacttcttcttcactagaaaattcactatccttattttcagtatacttctttaatatctgtattttcttaagtggaacatgtgttgcaaagaaatctccttttgaacttgttactgtatctgtacgtattacttcagaaattcttctttttgctatagctgaattcacagagcttaccccctaaccgtaatatgtgtaatagtagattttatttcgtgcaattctaatggatataagaaccacatttcaccaccatcaagtttatgctttaatgtgatttttcctttatcatgtaacattcttaatccattagaaaatgctaagttgaattttttttcattatcaatatattttaaagcaacttcacagtaaggtcttatagaatttactatatcagatacggcatgctctttattccgttcaaaattacatatttcaaatatttctcttaaattaatatacatattaggtaataaaagcatactatttttgcttcttgatggattttgcatttcctgcatataaccatagcctaaaaatgcagcccaaaacctccatgctctcatatcatcaacatttactctcatttttgttgatttctcgaataattcactcatatctgaaacactatcatatttaagaacctcttcactcattgccaaatattctcttgtaacattataaaaaagtccactttttagtgattcaagacgctttatacaatattttctcatgctagatatagagtctatatcctctttatctacagataaagaaataatcccttcctttatatttataaggcctagctgctgcgctgcagtcctaacatctccaaaatatgcagttgttcctcctaaaaaacgaggttcaagtctctctttcaattctttttctgcacttccattatttctaacttctttgcatagtgcaaatactctttcaggaattgcaggagttttcatacgctctgcaaacatcttaattcatcctttcaataatatatgattcaatttgtggaccattaataataccggaagccattttaccaatatgatcaaagtatatatcattttcaaatatatgaatattgcatatatttttattagcatattttctaatacaatttaattcaccaaatatcttagagggattattaccatataaaatagcattagtaccagatacgtaaaaataatcttcctcttttaataagtctatatattcatccattcccattatattcaaatgagtttctttttgtaaattcaatatcaaatccatatactttatttcatcttcatccgaaataacaatagttgttattcctttatttattaacgtattcaacaacctataattatcattcggactaaatattagtgcttcatctgcatttcctaataattcagaaataccaaaactaattttatttattggatcatttattcttttaagtaaagagaaatgattactttgaacatcaactatatcatcatgcatattacatcctgaacagtattctgaaactaattcataagtttcataaaacatttcagaccaacacattaattttgaattacttatagatcttttcataactttaaaatcatccatgaacttcttttttctttttctcttatttcacttataattttaaaagcacgcgcatcatctcttaataattcatcactaataatttcaatacttataagatatttttttgtttcaaaatcaaatattatatcagtaatatttattagcccatatcttctcaaaaatagaataacatacatattccattgaatatgcgttatatttatatcttcactataatcaggttcattataattaggcttaattgacgtatctaatgtataaattgatttatatcttttagaagatattccgtttaacatactttcccaacgtcctaaaatcttctctggcagcataactttatctgtcattttaaacgctgaatcgagatcctcttctgtgttaatacacataacacttaaacttggaagtccatctctaccgcctcttcctaattcctgataatatttgtttggattttcaggtacatatagatgaagcactgtcctaacatcacttttatctacacctactccaaaagcagaagttgctataatagtatcaaattcattattaacccattctttaataatacgttccctttcgttatttttagtctttcctgtaaaagtttctatattattaaacccgttatcccctaataattttttaacattatcagccttatccggtgacgtaacataaataactaaaggtctaggcaatttttttaccaattcaataatatggttattcttttctccataagaagaagtctgaactaatgaataacgcggttcttttctaagaaaatcacatcgtacttctatacatttatcttcactagaaaacatctgctttaatttttttacagtactcttttcaaatgtagcagataataaatatgttctaatctctgaattatataataataaattatttctccatgcttctatacactgataattaattctaaaatatgcaccccattcaataactatatgtgcttcatcaattactatattttttaaatatcttttttcatttgcttcttctattaactttttaaaattttgattttgaataagtgcttcaggggaaataaataataatttagcagtttcattctttatactattaatcatttcattttttatttcttcattcattccactataatagcaaaatatttcattattattatatgagtatatattactctttgctgcccttacttggtcaatagctaatgaaactgtaggcactagcactatagtaagactacgctctttctgatatgccaaaacctgagtaattaaacttttaccagcacctgttggaagagaaactactgttgtatatccatcaggagtctttagtgcacctacaactcctagcttctgttctaaagacttatattttttaaagcgtgtaagactataaacatatggtgaagttcccaaaaaatatttagagtcatttttctcttctttataatccttcataaaagctgattttatcaatttagaattaacatattgtggcatatctaaagaagcatatacttttccatatgaatcttttaatagtccaaaaccattattattaatatctattccttctttaagtacaacatctgtattaaaaactaataaataatttcttaaagaacataaaaaatcatttaacgaaatatccttttcggtaaatttatgacaattcttacataaacgtactgctgtatttaatttgaatttttctaatgaagaactacatttaatattaaataaagttttatcgtacttttcttttttccagttaaataatcttgtactaatatttctaattcatcttgcttcattcatttttcaccatccatacaaaagcagctgattctaaaacaaattttggtttctttaagctctctagaattatgctatatttatgtttttcatcatctatatttttcatatcatagttataatagtctgctgtagctattaaagaatttatatgtctacttatttcttcattagctccagtaatatttgagtatttttttattttttttctaacttcttcttttgcactttttgttgcctcagaaacatgatgtttccatttctctgaagtgaattttcctttaaaccattctacattagatatatctttattaattgaaatttttaaaaaatcttcacttatgcttctttttcctaaatgagcgatattttctttattatgaataaatccttctttaaaaattttatttaactcttcatttattgtaatatcactatgattatcattattctttaaacttatcggtattataatttgatctgatgcaagataattacgatattggcttaaagctatagatggaatattgttatcaatcaatattttctcatcaggttttattgaccatataaatactattccttcccagttaatagaagccttaactgcaaaagaacaactctgtcctctacttgacagcatagcattattaacaatacaatcaaatatttcatcacccggcgcaaaaaaatgcagataatcattttttatagaaagtcctctattaaatgtaccttcaatttttctatcatctgagctaatactttgttctttatccattaaatataattcttttatttttgtagtaaactcattttgttcagtactcatatattcgtcccacttaggtggtattaatattgaatttttagctgacttaggagaaaatgagtattgattaaaacttactatattatcatctatcctatgtccatttaatcctgcaagagaagcccaattcatcattgtttttgcaaataactgattttcattagtattataatatctaacaagtcttattaattcttgattcataggtttatataaatatgcagctgtatcaaaatactgctcctgtcttatctcattttccatttcctttgctttatctataattttatcaattgaattagacaaaccatatttaaagtcagatattattgccgaaataatattatcatttatttctcccattataatttcaagtccgctaatagactgattgaatatattcaatcctttatcccagaatttaaataactcttcctctagactctcacatgaatgtattactacagagactatatccttattcttttctcgtcctattctatctaaacgtcctattctctgttcaattgcattagcatcccatggtaaatctatgtgtattaaataatcagcacactgaaaatttcttccttctcctccagcttcatcacaaatcataatgtaacagtcttcatcattttgaaaacggtatgcattcacttctaattcctcagtattcatttttttattaaacactgcaatagaatctgctccaaatacttcttcaagtaaatctttataaatattaaatgtctctataaagtttgtaaataaaaccactttttctttatttgtaatttcctgatctatataatcaattacttctaaaattctacttgaataattatagggttcatttaataccttattaatgtctataattaagccattttcattaataagccactttttagcatattcatttaattcttctgataacttgtaaccttcttttatctttatttctagtgtgttattaaaagcaattgccgaactaaaaaatgctgcaaacaattgcatataacatttttcaaaaactgttttttcaatttcactagaagtaatattgctttccaattctttataagttaaatattcatatacatttctatctgcatccaattcatatttcttttctactaattttctttgtggcatatcgtctagatattttcttctatttcgaattatctttttctctatttgataattttcacagacataagaaattgcaatttgaataccatttacaccgaaatcatcagattcaaatgatatcttatctgataactctttaaatttcaagtcattaatcaatatcttatttaatttttttatactcgtatctatactatcaaataaatccgcacagtcttcatactcatttacatcaatttcttcatttttagcttcttcgatggcttctagataatcttctaaatcacttagtattaatgaagctgtttttgttatatcaccctgtttatttattaattctgaaaacttattttcattataacaatcatatttatcaggcataatcaattttaataataataaatattcattctttttatactgaacaggtgtagcacttaataataaaatattttcgcttttcatacttaaagtatgcaatttttcatactcaattttactatttaatattttatgaacttcatctaaaatagcaaaatcccaatcataatttaaatctttttgagataaatcctcttttgcttttaatacaatattattattcttatcatccttacctaatcttagattaaatttcaagaacatctcaatacgccattgttccaataaaggcttaggtactataataatattatttgaatttgattttcttgaaagatatattttcaatatagataatgcttctatagtctttcccattccaacttcatcagcaagcatatatctacactctttttcctgcaaacatctcataatagtttttaattgatgtggcataagtgatattttacaacctgctaactctttaaatccataaattgaattttcaagaatattcatagttttacttactattgttcttccaaaataccagcaaggattttgaaattcataatttgacagctgtttcgcaggatcactgcttccaatgttaaatggtgctttaattttatcttcacgcacttttatatattttttattatcttcagaatttaaataataatatgtccagttatctgatactgctctatctacaattctataattttctttatttacactaactactgaattattaaacaaaaagcatcttcttactaaatgttgaggtaagtctaacattccaggaatataagtataaaagtttttatacttatatggatcattaaatattactaatactgattcattaaacgtatctactgatacaatctgaccacaaataaaatccctaggattatcattatcctcatctattgcacatcttacatacataccaacttctaacatcccaatcccctactctatgaataatttatatgattcaagacatatttctttattagcacaatatttacaccattcatcacaatctttatcatatttcatatttgctaacgtttcgtctgaaaacatttttttcattttatcttgtgtaacattttcaaacttattttttaatatattttcatcagagttattattacttaatcttaaataaataaattcttttttctttttcatatattccaaatctttttcagtaagttctggaaactgttttaaattacctaatacttcattgataatgtatcgccttgcattagaaagtatatcaatcttatccaatggtattacaaatttgaattttctttctaatgatttatatgtactatttaatgcttcctctaaaataactctatttaaatgttgaccagccaacttttccctcacagcattttctaacaaaatctcataatactttaaaataagaaacttttctttatatttagtacctccttcaattaatgattctaaagcaaatttatatttgcatatgttatatttataaacatcaaaattattaaactctacatcatcttgtttgaatacttcaattttttctatattccttaaatcttcttcatcttcttttattaaatatggctcaggtttttttagtaatattttaagcatataatataaatcattttctttgccatcacaattcttaatataactcaatttaaaattaaccctattaaactgtaatccataaatcaaagcatatcttttgaagtttttatattcttttttagatttaataaaaacttgatatttccaatccaaaggttcatatgcatattcaaaaaattttatatctaaaggccaaggaaactgatcacggctttttatattcatatcattatctgataaacatgcaaaatgatatactttatcgttatcttgagtcgcactttgtaaaacatctccgtctatttgctcaaaatctcttacaatccagttagcgctttgtccttttgaattttcctgttttaagtaataattcatagtttcttttaagcattcaaaacttccagttacatttatattttcactattttctaaacgcctaagtaatctagtaataatatctttaaattcataatcaaaattactttcaagttctattttattttctataaaatcttttattttctcataaaaattttgaaaattgttttcttttttatcgaaatcctcataaaaaaagtttgcaatatcatttaattcagctaatgcagatattaatttttctaagagatttatatctgtattacaatatactaatcttgaaataatatctaattcttcttcatcatcatttttacttgctttctttaagttgttttttagtttgtttaagaaaacaataatttcattaatattttcagctcttgaaaaatactctttagttaaattaaatatagatgataattcacctgaaatttcttctttaataattccagcattaaaacattctaaaatattattcatattatctatcttaaccgcattactatctggatcccacatattagctatacctaagaaaaagtgtcctattggataagacaaaaaatgtcgttcaccaaactgctcaggaaaatatacttttaatatatcatttactgaattattagcagaataaaattgttccttcataaatccaagtgcagatttttttgctttatcttcatctttctcataatcataaacagcttgctgatatattttagctatataaccagcaaactctgtaatattatcaaattccataacttttatctttgctaataaattttctttatcttctaattttccctcagctaactgcgataatttttctgctagataatttccttcataactttttaataagttacttgttattaattcattatcaaactgactttttataggaatatcaaaattagaataaatatctatccatgtttgataaatactcttgtattgcttttgataattaaaaagtaatataacatctttatatctgcttatttcttctattgctttaagtataataggagaaaattgatgaacaccatgtataacaatggtcttataattattgtcataattacttttacttaaagcattacaaatagctgtatttatttcattctcattaaaattgctttttagtgtaaacttatctgttttattttctttaattatattattataaactgcaatcatacagcgttgttcgtatgttattttcgtacagtccaacttatttatatttatatttaattcgcataataaacgaatactatcaactatattctttttattaaactgtaaagactttttctctctctccttattcacttttctattaataatttcatcgactatagaatattgctcaatatataattctgaactagtccaattactatacattgattgaattaaattttctactgtagatagtgaactcaccgataattcatttatataagttgattttaacccatttaacattgtttgtgatacacaaaattgaacactattcttaacataatcccaataaggctctttgttaatctcataaggattactatacgtataaatagaaattgacattattgttcctccagtatatttctccaacttaatttagccttttgtttattatcctttaaccatacaaaatttcttattgatcgtgtaagtgctacatataatactcttgattcttcttgaactctctgttctatttcttcttttccatgataatttgaattcgactgtttaatcttatcatcaatttttatagagtaagctaaattaccgttttcataatttacatctaaatttgcttttttcaaattatctatagcctgatttgtgtatggaagaacgactgttccatattctaaaccttttgatttatgtatagttgtacatattatatgaattcctgaattattattaacaagatttctagataactcttcttgtttcgtaattatactaattttcaaactattacatatggaattaatagtcaaataatcaatgctataatttttaattattttttctaaaattaaatcataattttctttataaaatctttgtttttctttattatcactatactttttccatggcttagtataatcataaatatttttcaaaacttttagtacaggttcagtttgagttttatttatcaatttactccatgataaattcatacgtgcttcataaaacttatcaagtgccttcgataaataaaaaatcttttcctctttattcattccatgtaatttatatacatcaaatgaaatatccatattattagaattcaatagattatacaaataaactggttctcgtgcattatttaatgctaatactaatttatataaatccagcgctggaggtaattgatataaatcgcctccaacttctgtttctattaatatatttctctttttagcttctttaacaatttcatttatctgccagttttcacgaactaataatgctatagttctttcttcacgcgataatttattattttctgataatttttctattattgatttttctctatcaatttcatcgaataatacatcaaaaaaatcatcatcttcttttgtattgtatgaaacacactttattagttcgctttcatcaatttttgtatctattgaactaattagtgtatcatcatctttactaaatggcagttgcctatttcttcccatacatgagaaaattttatcaaatctttctaataatctactatctgtcctataattaatatttatagaaaactcattccactcttgattattttcttcattattgattagtttattaaatgcactaactgtagcccctctaaatctataaatgctctgcttaatatctcctactacaaataacttaaatccaataatatcttgtaattttagaaatgaatcaatttgtacatcatcagtatcctgaaattcatcaataaataaatacttataatgcaaattacacttattcttatatccattattaataacttgatttaataaaatcatactttctcttaaatcaatcttgttactttttataagttcttctttatattctttttctgcatttattattacctcttcaataacctcattaaaataaggcattaattcaataggctttccaaatgaactcttagatattgtttttatatcaatacttttgttatatagttgattagcaaagagcataagaatttttttaaatttatgtataggaagtggtagttctttattaaaattaggatttgcatcaagttttctcattatatacttatttaaatacttttcataaaatgattctctaacataatcacttgatgaaattgagaattcatttccaagacctaattcaaatgaagcactttgaattatacttttagcaaatttatgtattgttgatatctgcatttgatttatatcttcaataaattgcaaatacttggagttattagttaatatataataattaatgaataattgtttcaatctgcttttcatattatctgcagcttcattggtaaaagtaaccatagcaatttcatcagatatctttataatctcatcattagatttattacataaaaaagctattctggaaaccatagaatatgttttaccagtaccagctccagctttgactaatatatttttttattatcagcatgttctatgtagtactgtttactattaaactttgttatacaacttagcttatccaataatattgcttgatctttattagtacatccttctataataataacttcatttccattgctgatatcttccttgcaaagatatatttctaaattgaatattttgaagtattctatatttttagtaactagattctttatttcagaattaatatttaaattatttttatcgaaagatatattttttttactaaaattatctattataagtttctgtataaattcaatatcttccaacgttttaacaaaaattatcatcttaatccctttaaaataatcacttataatttcaaatgctttattttgagttatagattcagaaagaataataagcttagaatatggcttcctattattaattataattttattttcctcattatatgttggttcaaaatgttgtcttattttagctaacagcttttcatccatattatcatgttgtatatttttatatttattaaataaattattgattttaatacctaacaaccctggagttgataaatcttctttgagtattgtacattctttttccgatacaatatctagtctctttttattatattcagtttctgatatatatggataacataccatatccaaaactaacggactcacattaaatttatctttaagcatattaatcattgcaaacctatatgctcgtgcttgttttttgggcgaagtttgaggctcagaatatccatctattattattcgatcgacccctgctacatcaaaaatatgttttgcatcccatccttttacttctacaataactattccaatatttttaattaataaacaaaaatcaaattctcttgctttaatttctctatgattataaactataatatccataggtaagtttttcaaaaaagcatcccatactataccctcacatttaaactgcttcggctttacatctatcatcaatgccactaaaacacaccctctcctaattaatatttattttatactaacaaactaaaatttatattataacagtatctaaattagtagcataatatcctgataagtctactattattcctgaaatcacagaaataatagcaaccatgttaactacccattgtataatgtttgcattaaatattcgtttaataaaattctgataattatcatacttatgctaattaagatcaaaaaggttgaggatattaattcatatcctctaactttattattcatactctatttttctcaaataattattctattatttcccaaaaagccagatcattcataaataaagccctatcactatcacccatcttaacaatagaataatgtttattaagattctttatcttgctataaatgttttcttcttcacccttgctttgagtattgaatatatatttaacatctttattattcaagtcagtaacattatgaataacccaagttaaaatgtagttagcatattcattttcaccagtagagaaatggcttaataattgtgttgaaagaatagttccaaccccaaattccctaccttccttaagaatcttctttaatgatgaaaagttcttacttaaaaaattatctgcttcatctactaatactattttatttaactgtcttaggtttccatcaattttgctatgtccataagcttgcatctgcgaatagaataaatctaatgttattgcaacaactagattttgtattccaggatcatatcctgatagatctattactgttactccatcaattaactcaaataaactctttgtttcattgcaatctggttcaaaaatctcaaagtctatcaagttactaaatgcagcatataaactatcttctttcaaatcttctttgcttacatatatatcatatacatctttaagtgttggcgctggattatcccatgtatctggtttattctttattatgcctctcttttcataagcttccattattaaatctcttaataatgtttcctgcttgattccaagtccaaatgcttttgctattgtttccttcaatccatttgcagtatgaagtggtaacattggtttagaatttactgctttaacaactgacagtggattaaaaggtaaatgatataattcaaaaacctttgcatctgttgcatctataaaatcttgttttgatttattataatcacctttatagtcaaagattaatattccaacattcttaccatcaacattatatttagattctctatgaatctgcgtaaccatagatttagtaaattgagttttaccagtacccattgttcctatgattcctgtattggtatgcattagtttatttgtatcatttgggcaccaatatacttctttatgattcttttggttaactccaaataatatctgcatatttctctcagtatcaacatcactatctttgtattcagaacatgaatcagctactgatttactttctgtaattttcttttcaaaattatctgtttcaatatttatatctgtatttttatctgtaggtttatcaaaatcatcatcattagaacttactgcatcatcctgtatatgttctgtactcttgtcatttatattatcaatattactctgtgaatcaattgtaacatctgaatcttctctttgtaattttatattactcataacaccgatgctcttaatatcaactgtacctactttttctcttatttcaccaactgttttagttataaattctatcccatcattttctgtcatttctagaaccataacattgtcttctattctaatatcgctattcttgttttcatccttaaatgatattacagctgcttctcctaaagattcctcaaaagtattacttattatatattcttcatttaaaagtactcttctcaaatctgaatcaataacgctgttccagttttcttcattacatacactatataaatttaacttttcagcacttgtaaccaccaactgcatcaggaagtttctatataccttttgtgtattagttaactcctgcccttctttaggtaataatatttcactgaatattttctttgtagtcttagcctgctctattcccttattaacataccagttaggattatcccctattttaacttctattgggtaataatgaacataagtatttccatatacattttctataccaattaaaagaatatcatcactagtagcaccactattatcgaaacctagctgcttagctgataagaatccttcactttgcttaagaccagctccaccagaaactctcaatacttcttctaaagatatcggaacccagaccacattatcctttttaaatttagctaaagctaatttaattgctgataatatactgattttttcctttggaaaatgtgattttgtagataataatctaagaagccaatcaccattaaccgcattaaacatatttataacaccagaagaataatctttaggattttctattccttttttacttaaaaattcttctataactttttggtaaggtccactctttcttgtaactgtaatagcatcataaccacctgctgtagtatattgatcactatagtgaataataagaagatctttggcatctggatcattcttaaagaaattcaaatcaacttttggatctataaatgttacccaatgacttgcattatatatatcatctaatgttgctttatttttgttagcaactgatattgcagtacagctattgctgtcaaaagcttctccattaattgcagaatttactgcatttaatttacttgataccgtcattaaatctgtttcagtatttgcatatttagtaccaaatccggttctgtaatagtctcccgaaaaaacagatggaactcctgaaatcaatccatttaatattattcctgacggtatatcatccatattagattttattgtttttgcattattgctcatttcaataaatgtaatatgagcatactcaataccattgtctactttctttgaataaaaatgtaccttttctctatataaatctaatacatcctcttctgacatactacttacattcaagtctaaatcatacagttcttttaaatctttaatattatcattgaatgctacttcttcaaatgcattagtaattcccttgtttgaatatataaataaatctataggaagtacttcctttttcttagatttaagttgcttaatatagtatttaaatattccctgaagtatttccttactatctccagtatttattaaattgattcttataggtgcattattgcccatattaaataaatacttgaaatgatcaacaaactcagttattttttcattaactagcttagatacaaaatctcttgagcttttatatcttggtagtttatcatcaacataatatttccattctggtgaatgattctgttccattggaatgtataatctgtcttcacctacattaatatatggtaaaaggtatgttgaggtaaatttctttattatatcgtcctctaatacttcatctttaactgcatcattgatatgaagctgatatgcaatatttaatggatttagtggagtaaatagtaattccttatcttcatactctctctttatagttccaatcctaaataaagctttttgttttcttgttaaatattctttttcctctattttgtttaattctcttatatataccttaataaacctttcatataagtctttaagatcctcatttaaatatgttaagcttggtaatttattagatgttttaaaatatctcactatattttcaaatgcttctttgacatcatcatttagttctaaatcaacacactctaatccttcagatgtatcttcaaaagccataccttcaagctcaattatctgattttctaattgaaggttttttctaaattcatctcttgtaaagtattctttagttccatgttgaagcttattgtctccaataaacttaaaatcacatttcttttctcttttaagcttccatacttttaagccttcaataggagctattttttcacttgttcctataacaccaaaaggtattttatttccttcaatgcttattttaaactttactaaatcactatcattttcataatcaaaattatcacttatcttaagtattaatctatcatcttcagaaatttcaatttcttcataattattagttaattcgtaatcatttattgtagatgcaaactcattaaacacaattgatgattcgttagtatttattgaaatataactatatttcttattgtaaattacagaaaactttgtctttatactttcaaggtatttctcattacaagtaacaacaacaattctaaactcaaatttagtattttcatttttgtaaactatcttgtaaaaatttgcatttccatcacaattttttaaattaacttttatttttttaccacttgtagatacctctgcatcaccatcaactctgctcaaaaattctttatgtagtgtagcatcaaatggaagttccatatctattgtttcttctcttctttcattgaatattatcatattcctaattctagatttaacttttgatgccccttcttctctatcccaatcaacagtatttcctaaatactctaatataggtgtacttattctatcttctatatatttttttacatctttaaagtcagtatctttccattcttcacttttcagtttatctacacctttgttgtcaaaatacttttcaagctgaacctcaggatttccataactatgaatttcatcaactctattaaaatttgtagcattttcatcaattctattttttaattgttttcctgtataatcctttaatttactatcatagaacaatccaaaattcttatattgatctttttctatacatgttccattaacaatagctaataaatccttgtattcaaatatagaaatactttcacctaataattctttattttttctttcaatatctaaattgattatagctttatcaacttctgaaaaatttgaatcacttaattttctatttatatctttttctatagactttatatgaaaaggcattccttcctttgaaaaagactcagttcctcccataatactatccaatgttgtatcatgtataaataatatagctttgtccttatacccatcttcaactccaaccatatttcttaatcttgttaggaaatcaggctgtactccattaattgttgctgatattattagtttaacattaggaaaatcaagtaaataagatgtatacttaacattacctttagagtctttatattcatactctttatataaagtattgtttttaagttcatcatacaatgctaatacttgttcctgtttttcaaattgaatattatatttagcacctatgcttaatggattcatattaaaaaattctattattttatctgataaataactataaaattgatctgacatattgtgcatccccgctatctgatttcttttctaatagatttaatttttcatatagttgtattattttagctctcgaatctctatcaaatgaaattcctcttttttcaaattgtttaaataatacacttaacttcaatttttcattatctttgatacaaatcttagtcaataaaattatatcttcttcatttaaattcaaattatatccaagagatcctcttctttttgcaaaattatcttctacaaattttataaaccactttctataagcttcattagctcttgtccttgttgatgttttaccttggaactgatacttaactgcttcaaataatttataaactttatcaaatgctttattttcgctgctatctcttttaacagtaaaattatcccacacgattccatcttgtcttctttctatgtatgattcacaaagttcttcaatttgggcttctatatgcccatcatcttcctgcataatatcaaatagttctttataacctaactgcctttcaacattactatggtttaaaaattctaatgttatagcatgagagaaaagatcatccacatatccttttaataaagcccatccaaatttatatgctgtcctatttttcgatgtactttcaaaactaagtgtatagtatacagtttcaggttcatccaactttgctttttcaaattgaccaagcttaatcgcaagctgtgaaatataaaacatattataaaattctaaaaatctttttagtgaatttttatataattcttcatcagttattaaaaactttaaatcttctgcaaacaattctttaataaatggcaggtagcatttatatgcatcatctaaatatttcttttcattaagctgtggtaatgcatttagtacaagtttatataaaatattatcaacatctctattgtaatgctcattaactaattcctttatactatcatcaaaaaaaatagaataaagaaattttgctattttctcttctgcattagttgatgaaatataatttaatgtttttatatcaaaatcaataaggtttcctttatcaataaacatcgttctaataatatctctgaagctttccttactgtttactccttcaaattctccgatttcatcaactacattttcgataaaatcatcaatattgaagtctttttttaattctttatcacagataactcttgaaattgcacctacaactccatcgaagtttgatactaatgtcttttcattggctgcataaggcaataacttaaattctttacactggctatgagttaagccattttcaacaaatttaaaatctattcctattttctctaaatctaattcataaactctattctcatccatatcttatatctccacaaatctgtaagtttcaaattcttcatcaaattccagcttaaactgtttgttgttttctctattcttttctgtaaacacaatctcttcatgctgagatcctgcttcttcaagtttattaataaattctataaacttaatgaagtgatttttatctttcttattaggtctgtacccattattgacttggattaatagcttgtacaatgtataatcaatatctatttcataagacctatcagtattttcacccttatattttaacttcaaagttccaataaattttttcaaatcattttcatcatttttaggtaaattacttaaatctgatttcaattctattttctcactagctttatattttgtttgattccttccaagaaaaatattaatatgatttttttcttcagcttcaccattccacttcataataccttcttttacattgttataaaggtttttcaacttgaccttatcacctttattccaatagaaaagaacattcatatattcatcatattctttatctctaagtgaaaacagctcttctaatccacaaatataatagcttcttataaatagcttcaacagttcatgtcgtattttcttatcttgagtatcattaaaatcaatactatatatctttttaatataatttctaggataatcaatataattatcaaaataagacattaaatttgtagcattattaaattcaattatgaaatcatctactttttcatttctaacatttaacggatcaatattattcaacgcatcaaaaatgaatgataattctttatgttcaaaaattatatttggaagcaaagacttaatatagtcatgattattaagtttgcttattttacttttgaatgtaggtgaattcacatcaatgtatgatcttggaattattaattcatacataaagtttagtaaagctcttgtagaaataataattttgtcttttactatacattgaactaaaagatcaacaatagaatcctgaaccttttcttttgacaataattcataatttgcttttatagggcaacattcactattttcgcatttactacagttttttatatatgaactataaaaaatatttttttctataaagttatcttcaaatgattgtgttattttgtttattaaagacttaacataattggaatgaacttttccttcttttaaagtgaatatatgataatcactaaaatttacaaattgaaaagatctgttactatcaaaactactgtcctcaatacttgtatctaatatttttttatcttgtacaaatttctttaattttgtaaatctttctccatactctgaatctatgaaattatttaaagttcccaaatttattgccaaaataaacttttgattactattttcaatgttatcgtcactaaattcttctaaaacctcgtttaaagtatccattgaagttttgtttggttctaaactctcagtcgcatcattatgaagggtaaatttatccataatatctttatatttatttttaaaatatgaaattatatgagacttaccatctccaacactaccacatactaaaataagttgagcattttcagattcattagctttaagtattaactcatctagacttttttgtgcatctcttggaatatgcatgtactttttaaatggtgtaaattcacttaaactctcaactgcttcctttgaagattctttaagtcttgatagttcctgaactaaacatttcttatctggttcttctgtgtttaatatattttcaactaacaacccagtaaaagcatcatcaatattttctttgctttcagtagcaactgcttcttctatgtcttcattaattacttctaaattattatttttaaccatgagttcttccatggtctgtttcatcatattagctaatacttctgtgtctatagatgttgatttttcaattgatggcattggatttttatatggtaaagcttcatagttacgatcaatatagacctcaacaaaccagcttgttattttatatatatttttatgtatgtttaatgcagcttctaactcaccttctacattttcgtgagctgctttatttccaataattcttactgaatgaaataacttatatatctcttctgtgaatattccatcactttcaagtattctcagtctttcaatttgagtcatgttacttagcaaaccatgatcctctaacttagctacttcttgtgttaaattttctacaaaagttcttcccttaataatagcctcatgcggagacgtaaaaatagcattattaatatccctaatatagttatttaaatatctataatctttatctaaataactaaaaacctctttttccaataccgcttcatcctttccagttaaatgaatatattttacacataatatattcttattaaatattttatcatatttattaaatttttggggatttattctatatattaatcattttattctaattatttacctattttaatagaatgttcatattttaaataaatttatacactaaaaaagcctaacccttcgattagactctcctaaagccatattaaacacctacaaacatccaccaacaatcctaacaatatcctctccatacttactgcatttaacgtctccaaatccattaattttgcaaagtgaatcaatatccattggtttaattagtataatatcattcatttctttgtttgaaaaaatcatatatggtttaataccaagctctttacttttgttaagcctgtacttttttaactcttcttcaagagaagctgaaaatacttgttgttctttttcaatagtattttcatgattatcatcattgttagaaaaatcagtatatgtagttttaaagttatactcaacataatctgccttattactttcattatcatcctgtttattatatgtacttttatttgtactgctttttcccctattcttataattatttatattttcaacatgagcttctttaactgactcatctacattactataatttctaagcacataatataaaacattaattctatcttcactgagctttatagaggattttccaatatgagatttaatattttccactaaatcatttctattaattacagaaacattgtgtgaatgcactgttatattttttagtgtacaccttttactaaatacaattattgatcttacaaattcattttctattgcacatacattaatgagactcttaatatgagtagcattttgttttattggattataaaatttttctttcctcttatttttgaaaacctgtgtccaatatcgatcattttcattaccaaaaatccacccactatagttttttgattctataacataaataccactttcatgtatatatatcaaatcaatctctgtagttttaccattatcacatggaagataaacattagtaatgattttatgattaccttttattttttcaagttctctaaaggttagatactctccatacattcctttatctttaaatgcattgtcatatgaaattccagattcctgtgtgtatttttttctaacaatatgttctttttttaaaagtagtcctatagatataagtattaatactagtataagaaacataattattccccttattttgtaattatagttaaaattgtaacataattatacttatgttacaattttatcattttagtttcaaataattatttctcttgtatactatcttcaacattcctaatgtacaaccccatctttaaacaactgcaattatttttatctatgctaaaatacaccatctgcatcttaattccataaaaaaatccacatcttcatctataattaaagatatggattaaaagcattataacaatattctattgaattggaattattattgtttatttatattattatctgatgaatcaaaagcattatttaatgcatctggatcaatatttgttacaagttttattatgtcattatcattttttattttccatccgttttcttctttaaccatttctatatccatagttctatcgctaaatttaacattttttaatatttctgaaaaaatcttatcatatttagcatctgtatcttcttgagtctcagtatttcctgaaaatgcactgcttaaagcatccgaaaatgctttctgaataaattgagaaaatgcatccgctaaatcaggagcgttaacagacacatttactgttgcactatctccatcaactttttcagaatttactttataagtaattttcttaactgcttctaccatgctattttgtgaatctgtgtattgagaatcagtttcttcttcattttttatttcactatttaaaatatctgtaatagtgttcttatctccattttttatagcgtcaagtttctcactcatgaccttgcttggacttttagttccacatccgcttactgttgcaactaaaattattgcacacaaaaaatattaatttttttaagtagttcattattgtacccctgtctttttattatttgtattatatttaaattagtttttagttatcataataaaaacatttctatcactatttacataatacatcttctatattgtatcattaaatccatatttttcaaaacatatagctgtaactcctaacaagtaaatactacatttcattcccaacaatatgtgcaagaaaaaagccctgaatttcttcaggaccctttacaaaatcaatcatataattaaatatgtatatttctaattttcacttattttttaaatgttacttcagtttcttctccaaaaaatactgaagttctgcttggaattgtctttgcaattacttttccatttcttattgaataaagcacttctactcttcttcttactgcatcatatccgctgtcagcattaagtaaaatcaaattacctggctttccttcttcaataccgtattgcgcttctaaatttaaagtctttgcactatttgttgatatgaattttaaagattggtttatatcatcataccccatcatttgacatacatgaagtccaaaatttacaacctcaagcatatttcctgttcccattggataccatggatcaaaaatatcatcatggccaaagcatacatttattcctgcttcatttaattcttttactcttgtaattcctcttctctttggataagtatcaaatcttccttgaagatgagtatttacaaggggattagaaacaaaattaattccagacatttttagtaatctgaacaatttatatgtatatgcattattataagatcccattgctgtagtatgactaactgtaactttattctttaatccagtttcaagtgctcttgcagcaacagtttctaaaaatcttgattgttcatcatcaatttcatcacagtggacatctactaaaacatcatattttactgcaagttcaaacattttattaatagattctactccatattctcttgtaaattcaaaatgaggaatagctccaattacatctgcacctatctttaatgcttcttcaagaagttctaatccattaggatatgaaagaattccttcctgtggaaatgctactatctgaagtgttgcatattccttcacttcttctctaacttcaaccatagctttaagtgctgtaagatttgcatctgttacatcaacatgagttcttatatattgtataccatttgcaacctgccattctattgctttttttgctctgctttttacatcttcttttgttaagaactcttttctctgagcccatctttctataccttcaaaaagagtaccacttttattccattcaggttcaccagcagttaaagtagtatctaaatgaacatgtggttcaacaaatggtgaagaagctaaagctccatttccatctaatatttcttcattttcattttctattaaatcatggcctatttctgaaaaaacaccattttctattcttatgtctaccaattcatttctatctaaaagtcttacattctttattaacattgtatccaccttttctcaaatatttttccttaaaattttactagtgcatattttattatgcactagtaatcacaactttaatatatttttattttttgataaatttcattcctactacataaacaactattgttacaacaattgcatttattgctattataccaacatttatgaagtttgcagctacaaatcctgaaataaacgctgctactgctacccagtttatatctataaattttgtattttcaatactttcatattttcttttatttataaggaaataatctgctattaatattcctccaactggtggaagcattgagtttaataaattaagaaatcctacaaaattattgttcaaccatatagcacctacagttcctataagtccacatgctataactaatttgttcttaggaagctttgttatatttgaaagacctaagcctgctgtatatattgagttatcattagttgtccatatatttaatcctaaaactattattgccggaacaactaatccttgtgaaaacataacatcagctatatctgaatttccagtaaccattgcccctactgcaccaaataagaacattaaagaatttcctataaagaatgcaattacagttgtccacactgctgtctttttagtttttgcaaatcttgcaaagtcaggtgttgcagtaccaccacttataaatgaacctacacataaagtaactgctgtaactaaagtcattttatttgatggttcaatacccattaaaccttgaagtcctcctacagaatcagctgccataaatgcagatgtacttccaagaaccgctattgctggaactgctattgcacttaaaatagttaatgacttcattccaaagtaagcagttgctgtcattaaaattcctgttataccaactaataaatataaatttatattaaacctattagctataggaattgcaaacatggctataccaacaccaaaccatccgatttgagtaatactagttacaaaagatgcaatatatgatcctttttcaccaaaggaatatcttgcaagaagatgcattgaaagtccactttcagctcccatatatgctaaagcacctgtgtaacatgctaatataaagttacctataagaactgctataaagaaatatttaagtggaagccctgttccaagatttcctcctgtaagcatacttgctgaaaagaatgtaaatccaagcattactacaaacattgagaaaaatccttttttctctttttcatgtacatgggttaatgcataatcgtgatcattagtgttttttgttttttccataaaaatttcactcctaaatttaatatttaggaaaaccagtacttttatacaattcaaaatttgaaagtattttttcttttgttacataaaaataaaggaactgctactaattaataattagtataacagtcccttaatatctatataatctttgatactccacaatatcaatgtgtttcatctatgtgttatacgaccttgtttgtctcacaggacataacttaaaggactagttttctctcttgaaatgattatacatatcatgtcgaaacttgtcaatatttctttttaaactttacctttaaagcctatgaaactgtaaatttcatctataaataagcacaatatcaaattatattaaaattttcacattatttaatctttatttcatcacctatatcaaacttatcgctatttagcataattgtatctatatgtgtttctaacatcatttcaggatgagaatcttcaaattcagctatatattgattttctgcattttcatctttacatataactttatcatcttcatatacagaatttctgtaatcatctgatccatctgtaaatatgctgcttataccttcagctaacataaaactttttatatcagaatctgaactacagtatacacgtatcttattatttgctctttcaacttttatttcaccttttgttccatctgtaaattctacttctttattgtactttacattattctctgttactgcttcttttgataatttttcatacaatgaactatcattgtacttcgcttcaatttcatcatatgtcatagtacattttactggtataatacttatactatctgcatcctttatatcattgtaagtaagcttttctgattcaaaattacatttatatgtttcatcatcttcactataacttcttccaccaatataatctgtacgatacattttatttcctacctttattataaaacaaggctccattatgctataataacttccatgccttatatcttccacaggtcttgatacaataatacttgtgccaatagcatcgctttcaaatcccagaactttattatttttatcaatattcacatcaagatccgttttcatatactgtttaaaactttcagtaaaatctactggtattacaagacttccgttaaaatcatattctccaattactaaatcagctcttatatttcctttttcagaaaatccattttcacttttttcttctgagcttatttcaattgtatttttattaggatatgaccatgatgaaccaccaccattagattcttctttctccttatgcatatttaactcaatacttctatgactcatgatatcttcatcaaatccatcttctcgtgtaatagttgcatttatctttatcttgttccttgttccaataatatcagttattgtaagttttacaccattttgctctatttcataattcgcatttccactctttgatgatgatgcttcattttgtatactttgagtttctgatgcatatgcttgtacaggtattattcctattgacatcataaataccataatacctgctgcagggcctataattttacttattttcttgtttatcattaaactccactcctttatatatggctctgccatgttcttatttaattttaacttctttaccaaattcaaatttttcgctataacttaatatatcatcattacaatagacatgtagattggcatctttatctacacctgcaaattcaacaatatacccatacttgctatctggatctttatatattgatttttcagcatcaccataataattgctatcattattatgttcaatccatccattcattccgcatgccataagtatgctcttattttcagaatccgtgtctatatatagtttaactttattatcatctttttctactttggtaacttcaccatcttttccatccttaaagtcaaagtcttttttgtaagttacattatcaaaagtttccatattatcttcagaatcataattcatagtattgtatatttgttctttgtccttgtttgttagggtgcatgctactggaattaatgttatactttccgcattgcaaatagtatcatatttcaattctctgcatgtatatctcccctcatttccttctccataaaaattattatctttatcattaaattcatataattttccatcacattttattaacatcttggaatcagaatctgaataactgttttcataatcataatcatcactatactcatcttctttaaaataaactgaagttcctaacacgtcagcttcaaccttattgtatgttatttttgccttatcattatatatatcaatatctctttctattgtcttatcaatgtttttagataaatctacattaacattaacccatgcattaagattatattctggtataataacatcaaatcttaagtcagcatttaaaggaaggtcttcaaaacctgccacatcaaaatttacttctaatgtcctgtcattaataattcttctgtcaccccagtctgattcaagtttagctttcttcactgtaaatataaatattgaatcatttatagcttcttgtgttatctcatttggaaattctatagtagtagttacattcatcctattttttgccgctgtcaacttatttattgtaaccttaaatccatttttttctactgtgctgtttatataagttgtgtagtcagtttttacactttcttcataagctgaatttgccatatttttttcctgtgctgaaactggcacagtcattacccccatagcaaacataaagctcataattccagataatggtgcaagcattttactaatttgtttcgttttcatcatatctcccccatagcttatatttaacatataatatatttatatctatatatatatctatatctatatctatatctatatctatatctatatctatatctatatctatatctattaataattataatataatatggatataataaccacatatattgtatattttttccttaagagctttctctaaagtgcaaaaagccctgaatattcgtcagggcttttaggcttatgttcttacgtaagtaatactatatttatttttaaattatctaagctgcaccatgttttatagtagattttttatcatttattctcttaagtattgagatacaatttcaccaaagtacattgtatatccattttcttcttcatcaagattaagttctggatttacactgtttacatctactttctgttttaatataaccttacattcatagtacatattgcatccatctataacaggactttcgactacttttccagaaatgaatttaattccagtaagttcttctttgttcacatctcttcctgaattgtgtccacataagtctattgccttatcaaaacttctgccatatggaatacttattgtaaatgtatttcccttgtctataaattctttagtgtatcttatatcacttattacaactgagaagattttctttttccacatgtacccaacacttccccatgtaattgacattgtgttagctttatactcatttccagaagataaaaacccacctatactatttaaacaattaatcgacttttctatctgcaagatttcatcttccattgcccttcctcctattgttactttattaaaattacaacacaaccgacattatttgatatccataatcttttatctcctattattactttgttaaaattacaaccaatatagatatctatatacatacttatgacatattacaatatcattttctattaattacaaccaatatatatatatacggtaattatggactaaattaaatattcaatactcttttcaagttttcaaacataagcttttgaacaaaatctgatggatgcaaaccatcattttcacatccctcttcaaacattatttcttcaatagaaagattatttatatgtaaatactcaagaataaaggaataattatctacaagtaaaatattctctttctctgctacattttttaatactgctgtaacatcatccatatgataaagcctatttggacgtccttcattttctattgttgatggtattggtgaaaatagaatcatagacttatttttttctcttaaaaagtttataattcttactgaattttcatataaatcattcataccattatgattttttctatcattagctccaaacattaaaaatacaatatcatcatcttcattaataagatttcttatattattatatatctgacaagaagaagctccacaacctccattattaataactgagcatccatgaaatttttcacctatataattttcaaataatgtcccccagctgtttggggcaattattctataaaatttctttatatcatcttcaaaaatcactttatcgctgctataactttgtgaacttccttttcctgcggctatactatctccaataatattaatctttgctccatttttaattatatctataaatctgtccttatctaatattttagccacttttccctctccttctttattactattttctctcttctactgttttaagaaaaatcccttgttcaaatccgccacgtttttctcgtttctcacttctaactttaagaagttcttcttcacttacacccaagatatctgcaatagcaaaaacaacttccattatatctgcaagttcatctatatttctattatctgcaaggaattcatttacttcttcttggagttttttctgtaataatctaaactttcttctgccatcaatcatttcaaaatcacatattttataatctatatcaattatctctggaattttgtctctaactaatttgttatatacctttatgttctccataatcttatcctttcaaaaactctttcattgcaatgtcataatatattaattataacacatgacattatttcttaatatttaaataatttgtaaaattataaatccagttataaatcaatcttcatatatgacattaagttattatgaaaataataacaataatccttattcaacttctaacccttgattagtaaattgaatatgctataatttataacaaaatggaggtgtatttgtatgaaagaagttaaaactttcaactatttatcaggaagctccttgcaaagattacaacaaagccatctatgctttgtctggagcctaatcttatgttaaattaactaaaaacctatattttaggttctgacacatggcttttagtattctttgcttcaatactatgattttttattagtgaaggagtaagaatatgaaatatgtaaaagcacaggatgtgttacctgaagaattaattgaattaatccaaaaatatatagatggaaattatctttatatccctagaaaagacgataatcataaatcctggggtgaaaatagtggtataaaaaatatacttaagattagaaataaagaaatttatataaaatataataatggtatgagtgttgatgctttatctaatgaatattatctttcagaaaaaagtatccgaagaataataagttatgaaaagaaaatatgctcataatcggtacagaaatgtttaatagattgaataccccttttctagcatggtatcatttgtcttgtgtcctattaaaattatgattacatgaaaatagaaaagaggtgttttaatttatggaaccgttcataaaaaaacatgagtacaattttataaaacaatgtctttttaatttaaataatacttttagaggatgtattgataataaaattgtagaaacaaataaaatttatcttcagaataaaattctcaatcaatttagtaatttatctgaagttgaaaaagaaatactaagcatagatcatataactgatccacaacatattgacatatatataaagcatttagataagtatgtttatggtatggcacagatttctgattctcagataagtaaattattcaaaaaagaaaaaaagcttaaatttccatcattagaagtaagagaatctaaaaattcatatcttggatggattgatgaagctacacgaaaactatttattattcataatatggctggtaaaaatataggtatgagctgcagaattgtaaaccaaaactcaaatacttctcatatttgttcattttgtaataatgctggttctgatgctgaaatagcatttgtttcaacaatatgcaaaacaaatgctaagtatggaaattataaatcaataggattttctgtatgtctagacagccaaaaatgcaataatcaaattacatctttagataaattagagaaaattttaaaggaggctaataatataatttagttttaatacctagattatatcaatcctgacatataagcagtaatataagatcatgctctaattggttttcttttaaaaatggtgaatttccatttgttattgatactgaaactgtaccaataacaaattatttaatccttatctttgaaagttaagttaaaagataaggattaaatttaaacttatttaaagtttttttaatataagattatacaattcattaaatgttttatcacgtgtaataaataaaattcctacatatataattgcacaacaaatcacatctgcagcacatgaaaataatatattttcaacatttgaatttataaacatacatacaggtataaatattaatgaataaaacaaatacttcatattattcagtgaaaataattttatatcaatttttataacttttttaacaagataaccatattctaaacttatcaaaaatatatttgcaataagagttgtaaaaactgctgttgttggagtaaaaatcccccctaacactagtgcgtaatttaatataagatttagtattcccccgtataaggcaagcttcgtatctgctttttcatatccaaatacatatattatctgctgttctataattctgtctattcctactgccataagatatattgaaaataccataagtattggaactgctgcaatatatgtgtatccacgtccaaatattataactgcctgtttagatacacataacaatcctattgatgcaggaaataacaaaataaaatatatgcttataactttctttaaaagttgcatatatacttcttttgatttattagcaaggtaatttacaagtctcgccattgatacctgtattattgtaaatattaaaatatcaattatgttcattattttaaaggatatcgcataaaaacctgtttcagtagaacctatataattatctatcataaccctatctagctgggtatatagaagatatgtatttgataaaataagagtctgaaacatgggttttaaatgcctctttatctcaacatctctaaaatcaaattttgttctcttccttatataaataaaacttaaaatattattaataaaattaaatcctacaagaatataaagataaagcaggtaattgctttcatcttttacacaaaatattactaatacagaatatattattcttgtaaccattgtctttatagctataaagtcataattttctaaagcttcatttatccattcaacataaaaaatattaaacaatacatttccgcccataatcaagcatgtataaaagggagcctttccattgtatttaaatattatataggcagtatatgaaattgttgtaagtaatgttgttgtggtggttataacaaaaaggctagttattgtcttattcaacttttctttatcattacgtaccctgcttatttctcttaacccatattgtgatacaccaaaacatgcaaatgtcataaaaattgtattacatgtttcaccaactgaaatatatccattatatgtttctttaatagctccaagaacaattggtgttataataattggaagcgctatattaaataaattaagtattgtcttaaatatcgcattttttgaaattgatttattcatagttatttcctctatagttttattctaaatatattttgcttttaatctacccttattttccaataggtaatattttaagctttatattcatattggtcaacatttttaaaacttaaataatcaattcataccacaataaacttaaatagacttaaaaatttattactttattgctattcttaataaatactctagaaaatttacataattaataatatttaaatttataatataattggcttatacatactgtttatatataaatttatactaaatacctttttatatttaaatgttgttacatattgataaaattgaaaacaatactttgttaattagttagaaatactttataaattatggctaactaattaataattttctaaatgtatatttataatttcatcagctgaagcatatgaaccattttttaatatatcgaaaaagattttcatataatcaaagttttcttcagaatttattaaagaataaaaactataataatgtccaatatattttgtagcaattcctttaaatttccaaagccaagaatttaaaccacctataaaatttttcatacttttacataccttaaaatcatctttcatatgacgtataccaacccaatttatatatactttaaatccatactttttctttatatctttatgtaaatttttattatgctctattgtacattcttcaattttctttttattaatacgttccaaatgtacataacatccactttccgtattatctaatacattatatttaaaagtatctttcaatgtttcattgttatcttttacattaataagtggtattgcatcatcctctgcagatattaatatttcaacatcacgaggcatatatccatacattttcgcagttctattctcaatcttatcttcatatgtataatgtttatttctacttcccttaaaacattttgttacataataatccatgactgatacagaccttctaaatgattctggcttataataattttcaactgcatgtaaaatcttatgtctccagtaaaatgctgttgttgttgtaatttttaaaattctagcactggattcaagagtcatcccctcacacattaactcaataaattcaatccatttttctggtttatatttcaagtatttccatacagaaaatgtagtatttgaaaaggtttttctacattcttcatttttacacttatatctttgtatatcttggtactttccatatttaatgaagtgtttacagccacaatatgggcagctctcatattcctttatattatgtttatcataaattttttctttaagggttaattttttatacttttcaaattttttcaaatcataatcagtctttatcacaatatcattctccttaacacccataaacattaacatgatatagggatatattataaatgtatctctttaaaatttgcaaatcataaagctctatacttaattaaagttcatactcaatttgttatttagatcattgccaatttatttattttttaaacataacaacatttcattataaaaaggtttttcatgtaaatttatacataataccactactataataaattaaacatctgagtttcatgtaatattcccctacttctcaacaatacattatagtcatttactattaattatcttcacataaaaatagatgttcagaaaacattgttcctgaacatctgtttataaaattatttaacgcccatccatcctgaaataaccatcatctgcacttctgatgttccttcatagatttctgttattttagcatcacgcatcattctttcaattggataatcacttgtatatccataaccaccgaataattgtaaacaacgtcttgttacatcactagcattatttgcggaaacaagttttgccattgcagctaaatgtgtgaatctttcatgatcatcttttgcacatgctgcttggtatactaaaagttttgctgcttctgtatttgcacgcatctttgcaagttcaaactgagtattctggaattttgatataggacgaccaaactgaacacgttctttaacatattttacagtttcatctattgctccttctgcaattccaagagcctgtgctgcaatacctatacgtcctccatcaagagttgccattgcaatattgaatcctctaccttcttctcctaatagattttcctttggaactatgcaattatcaaagaataattcacatgtagatgatgcacgaattcccatctttaattcatgacttccaactgaaaaacctgggaaatctttttcaattatgaaagctgaaattccctttgttcccttactcttatcggtcatagcaaaaacaatataagtatctgcatatccagcattagtaataaatatcttactaccgtttaatacataatgatctccttcaagtactgctgttgtcttttgcattgaagcatcagttccagcaactggttctgtaagtgcaaatgcacctaatttttctcctgatgcaagtggttttaaatatttatttttctgctcttctgtaccatatgtgtaaattggtgttgcacaaagacttgtgtgtgcagaaactataactcctgttgttccacaacatttagaaagttcttctacgcattgaatataacttaatgtatccatacctgctccaccatattcttcaggaaaaggaattccaagtaaccccatttcagccattttagctacattttcttctggaaatctcattgtctcatcaatttctttagctattggctttacttcattttctgcaaactcacgatacatctcctgtaattgtgtatgattttcatcttgtttaaaattcatattaaactcctacctttctttttttgcaacaagctatctataattaaaaattaaaattgcaattaaattctttcaaaattttttatatctaatgtatatcaaacattgaactatctataagatttaaaattcaaatatgtttttaatcaatttgtaaaaatcgttaatttattttaaactgcagaatattttaagttaatttcattttattaatctaaacctttaggctttagttatatataaatttttatttattatcatccaatgaacagcatactttacctggattcataattaaatttggatcaaagacctttttaatacccttcatcaaattcatatttatgtctccaacactctctgctaaataattcatctttccgctgcctatgccatgttctccagaaacaagacctccacattgtgtcgcttctttataaataatcttaaagaatttatctactcttgtcttaaattcttcttcttctagatcattactgcattgatatatgtgaagatttccatctccggcatggccaaaactcttaattgtaattccacagtcttcagctgttttatttactaatgcaagataagaagaaatcttatttactggaactaccacatcacattcatccaataattttgtttctgccataattgcctccaagaagcttgaacgtgcagcccatgcatccttcatctttgctggtgtatctgctacaagaacatcaattgcaccttcctctaataccatttcacttgtttcttcaataagtgtatttaattcatcttcacttgatgcatctaaagtaacaagtaaataagcatttgctgttgttccatctacaacctgtgggaaaacactctttccaatatatctttcactagaaagaacaatttctctttccataaattctaatgcctgtggattcatatgtgccattttaaatttaggaacagtagaaatacagtcatctaagttttcaaaaggaattataagacttgcaagcatctttggtgctggcataaccttcaatgtaagttctgtaattataccaagtgtaccttctgatccaatcatcaaatttaaaagactatatcctgaacttgtcttagatactgttgctccaaatttagtaatttctcctgttggaagtacaactgtcattgaacgtacataatctcgtgttgcaccatatttaacagctctcattcctccagcatttgttgaaacgtttccacctaaacatgctaatttctcacctggatctggagcatataataatccctgttttgcacaatcctcagcaagatcatttaataagacacccgcttccacatttacaacaaaattttctaaatcataagataatattttattcatctttgttatatctattaaaactccacctaaaactggaactgcaccacctacaagtcctgttcctgcaccccttggagtcactggtattttattttcattacatatcttaactactttgcttacctcttctgtagaatgtgccataaagactacctgtggagcacatttaccgtaaataggcatttcatcatgagaataatcttcatttatatcatctccacttaaaatatgccctggagctgcctcctttaattttaatattaaatcttctgttaatatgttgtactgagccataatactcattcctcctattaatctatatttcaattggtaatctaataaaatatctgccaaattgaatctatatcaataattttaatttataagctttgttacaatttatatctacttaataactgaaatttttaattctaatttttagtatttttataatataaatgttccaaggaagcatacaattccagcaataactacgtagcatacaaaatatttaaatacgcttcttaaaattttactttcagaaccagacttatcaattgcacttgcaccaattgcaatactttgaggacagatcatttttccaatacctgctccaagagtatttgcagctgccatccatgctccagaaagtccaagattttgtgctgtctctacttgcaagcctccaaaaagtacacttgttgaggttccagaacctgtgacaaatgatccaattgctccaattagtggtgatattaatggatatgctccacctgtaattacaactaaaaagcttgcaatatctgcaatcattccactataactcatagtctttgctgttgccataactgcgcaaattgtaacaattgttttccaatttgcttttaatgtatcaatcaatacctcaaacatcaatgatacttttgccttttgaataaagcctccaataatggcagcaataaaaataattatacctggcgtattaatccagctgaaagtcaatgtgtttcctccctgaccggcatatacacacacactagttttaaaacctgaaataagattatgaatcggtgcacacaatgttgatgtcattattaacataaagaatattaaaataaatggacaccatgcttgtactgattctctaaatgataaagatttttcttcattatgattattgatttcaatacagtattctttctgaggttttttattaaatacttttgcagcagcaattgtacatatcatacaacaaattgatcctactatatcaggtaattctaccccaagtactgttgcagtaaaaaatgaaggtattgtaaatgatagtgccgcaaccaacgtaactggaaatactccctttaatgcctttattccaccgcctacaatgcataccataataaatggacttataaaacatagaaccgattgaattattgctgtatttgtagctaatacgttagcttgaactccagttacagctgaaagcgttaccaaaggtatgcctactgaaccaaatgcagttggtgtagtgttagcaacaagacaagaaataactgctgcaaatggatttagtcctactcctgcaagtatagatgctggaatagcaacagctgttccaaacccagccataccttccataaaatttccgaagccccatccgataattagtattaaaactcttttatcaatagaaactccagcaagcatcttttttatagaatccattgcacctgtacgcaaaatcaaattatacgtaaataaagctgcaataataactagacaaattggccatagtgcattgagtattccttccaatactcctgtaacagtgcaggctacattaagtttccacaaaaatgtagctaaacccattgtaagaataagtgcaatagtgcaggctttataaccgggcatttttaatttactcaatgcaacgataagccaaagaattggtaatattgccattaaaaatttaagaaacagcattccacttcctccttattaagttattatctgatactatatattaattggtactaccattaatattatgattttacgattcaaaatatgttaatttaatactacttttcaataaatattaaatttattacttttataccattacttaatataatcgtgatacataatattattcttgtaatactattggataaaactttatggataaagactaaaattttttcaaacaagctatagccaatttaatagcaatagcctgttaaatacagttaaatctaaaatcaagttatttggcttttactttcttcatttcttcaatcatagaaggaagaatctcatttacatttccaacgataccaacattggcaatttcaaaaattggagcatcctcatctttattaattgcaacaatataatctgatcctaacatcccagatgtatgttgtgttgctccagaaataccgcatgcaatataaagttttggtgctacaatctttcctgattgaccaacttgatgtgcacgagaaatccatccattttcaataggtggtctagatgcacccacaacaccgccaagtacctctgccaattcttcaactaacttaaaattctctgcagttcccataccacgtccaccagaaacaattaccttagcctcttctaaattaacagattcagaaatttcctttaccacatcaataatctttgctttaacagtatctgctggaacttctatagatttcactgttacatctttcttcaaaccaggctctggttttgggtaactaccatttctaactgtaactatagctgtaccttcaacttcaatattttctagaattgtaccgccataagctggtctagtatatatagtttttccatcatttatatcaatttttattacatcactaacgcatcctaaattcatacgtcctgagattcgaggtgcaagatcttttgctaatgttgtatttgctagaaatactaaatcaggtttttgttccttgattatttctgataatacttttgttaaagtatcacaatctgaatttatatcggtaaaaataactggaattccaaaagaagctaccgtatctgcagcttctctgtttcctgctacaactgctgttccttctgcatttaactcttttaatgtactgattagttcaaggcttccacctagcaccttttctccacatgtctcaataaaaactaatgctttcatatactcaatccccccttttattaaattaccttatcctttttcatttgatccatagcagcacttattgctacattaacatccttctcttgaatcttaataccagcttctttcttaggaggttcaacatatttaatgcaatgtactttagatttttttacttctccaatctcttctgcactataagttggaattacagccttacgactcttcattttactcttaattgttggataacgtggatcataattaggcttactcactgttatcacagctggagacttcattgaaactaaattatacccttcttctgtttcttgatgaacttcaatattatcatcttttaaatcgatttcaacagcactactaacaaacccaacttctaacttttcagaaagaattgctccaacttgtccagtaatttcatctgttgattcttttccacatagaattaaatcaaatttttcacccttatctttttcaattttatgaatagcatctgctaaagcctgtgctgctcccatagcatctaaatctgaatatagatcatcttttacaaaaaatgcttcttttgctccaacagaaagacaattttttaatgtatttagacagtcctctgctccaaccgttaatacacttactgctccttcattagcttctataaagcgtactgccatttctaaagcataagtatcaaacgcatttgctactaggctaactccatttaagttaggttttttttcactatcagccaaatggatttcaaccgaatcatccggaacctgttttacacataacagaatattcatagattacctctcctttaccctttcgaattattgttttataaagttgagccattgataaaaccactatgaattcaattttttaattcataccaatacataccattttaataatacttagatttataataaaaaagcatcttggtggtactaccaattcacaactacactttaccatattatcccatacttttcaataatataaataattatttataaaatattttttaatagaaccatatattctgatttcatttaaaatcaagcctccatatttaagcttatcagtgactttgtgcgatgaattttataatttaaaatttttcttaaatttttgaaaatcttatattttaaataagaaaatattaatagtatatattttcttatttaaaatcattacaaattattctcattataatttaataattaagtattataattattgaatttaattattctatataaactttagaaaaccatagctaaaatatagtctgcatatgttgtaatataaaacttatataaaatttttaaattaaatgttgttaatgattaccaaacagataatatgtcaataatcaaaatgtaataaactaaaatacactagatcattatttcttaaataacaatctagttagtaatatatatgccctataaatctatttcaaaacaattattgaattatattcaataatataattataattctataatctcagatcaacctatagattaaattttaggcggtgattttttgatactaaaagatagtacatttgataaactaagtttataccagagtaaatctttaaagaaaactatatacagtagagaaaatattaaagaatattcatgttgtcctcattgtaaaaatgttgaatttatcaagtttggaaaatatgatggtattcaaagatatagatgtaaatcatgcaaaaaaacattttcagacactacaaattcattatggaaatacttaaagcatcctcctgaaaaatggtttaaatttattgaactattaggagaaaagaaaacacttgaatattgtgctaaaactcttaaaatttctatagttactgcttttaattggagacataaggctcttcatggcatagaaaaaatatacaaaccaacagaatttaaggatcttatttttatggaaatttactatagcaggcgaaattataaaggaagtagaaataaacattttgaatttaaatgtgatttttataagacttacaatattgctcgcagagatgtatatactgtaatttcatatgatgttaatgattgtttaattgttgaaaatgttggtttagatagattatgggaaaaaaattttgaagataatatatatggtttatgtaaccccgattcatacattcatatagatccaacctttacaaaaccacttcattttcatgtagttaatcataataaaaaacttccctataaaatacgaaaaaaagttaattttaatccaaaatcatattatgccatggataacattaaatgcacaggtaaatcacataatatatctgtaaagctaaataactggattggagatttcagaggtgtagctacaaaataccttaatcattactgcaaactattttctttactatttgttgataaaacttttaattatatagatattttttttgaattgctatctgtatccccttattcatctatgaaagatataaaacacatccatctagagaattatttaatttaatatattcatgatttttctatctatagagaatttaatactaataaaaattaaactaacaataatagactataacaacatttattttaaaaatttgataggatttttacaatatgcacaacacactctttttacaaaagtatatacatattttaatatattttttatgtattaattttattatctagtaatacttattttgtatgcttaactgaccttaatttccttaataaaaagccatgaatttcttcatagcttttagttaaaattattcatatattgtataaatatcatctaaattctttcttacttttttgcgcacatctttactatctggatatcccatagcaattactagcctaactcttttaccactttgaatatttaataacttttttaatgatttctcattaaaccaccctaaaatacaggtaccaagttctaattcttctgccataagacatatatgttcacatgcaattgccacatcagttgctctaaaatcctgcttttttattagctctcctgctctacttgttatatttccactttcctcaacagctataataaatgtcttacattcacttgtaaatttattcattatagaatcctgtaaacaatcggccactttggataaaagatccttattgtttacaacaataaaatgccatggctgactattacaagctgaaggtgccactcttgcagcttctatacattttataatcttttccttttcaacaggtttatctaaatatttcctgcaactctgacgtctatttacaaggtctaaaaaatccttcactctttcacatccaatctacccacaaatataaattcctcttaacaaattttaaaaatcaaaagttgataatttataaattttagttaataattattttttctcatagttgaaatttataaatttattatacactaaaaaatggcagcaataaacatgctgccataaattctaaagtgttctttctttttctctgtaatcttccattaagtctgtatagaagtttactagtgtagttccacaataaggtgttacatataatgcaagaagtcctaatgttagtgcacatagtattccccatccaataaaactaaggtttaatacaaataaatcacctttatatcccttcattgcaagtcttgaagttcttaaacattcaataattcctttttcaggttcgtcaatataaatatataatgcctgtgaatacattaatgataaaataatacctggtataataaataaaataaacccaaaaaacatcataactcctgataagaaaacaatgcaaaatccttttaaataatatttacatcctgaaaataacataccaactgatacatcttcatttcttcttaccgcaaaataatataaaagacatccaattcccaataatgtaacatagatttgaacaactatgtcaagtatccctacaataacttccgactctacaaaatatccaacaatactaggaattaatgcaataataaataatataagagtaattaaggctcctgttcctctctttccccttaattgttgttttgcatcttctttaagttctgctcttcttctcatattttacctccatttttactttaatataattcttcattagttttttgtctttaattccttataaatatcaccccatatatttttaattttaggaatagctatgcaattataacatgttttttcaaatttatccacttttacctggtaaaagtaaaattaataaatatatgaataactatttttatggaaattatactttaagttaatatttataaaaagcagataaccatactaatcctaatatggttatctgcttacataataaaaatcaatttaaattttataatatattgcttaacttaaaatttcagaaatcctaataatcctatataatattatttcaatgccaattcatcactattttttaagcatatatccacaaactcttcaaaaagtttaagttggtcttccattccttctggatgccactgaactcctgccatataaaagtccccttcatattcaacaccttcaattacaccatcctcacaacatttagctgtaattctaagatctgttccaatttgtttaatacattgctcatgaaaagaattgactggaacttcctgttcattatatgcatttttaagacgtgaatcttctgctaatacaactctatgaagtttctcacttattctgcaaccagttcctttatgatatacagcagtattaagctgactatcaatattctgtactagagttcctccctgcattacattaatgagctgacaccctctgcatacaccaagtataggttttttcttcttctttgctgctaaaaataaatccctttcaaatccattacgtaaaacatcttcttttgtttcctctcctaaaggtttttctccataccattgtgattctacgttacatcctccagtaaatataattccatttacacaatctataagtttattaagttcttgatcatcatatttctgaagcactggcaaaatcataggtataccatttgctttttcgattttttctatatactcatatccaacttgtgaatagtttctaaatacgtcttttcttatatatgatgtaatccctattaccggcttcatttcgcatccctttcctctcaattttattgcaaatctatttttttaacttggtaaatcataatatttttaattgtttattccacttaacagtagattattggcttaaattaaaaattctctatcaaatataaaatttcatacataaagcctaaactatatatactatattatgttttatagtctaatatatttactttatttttaactctaaaatatattgaaatcatctataatttttataaattattgttcaaatattttctcacctataatttataaagtaaaaaattaagccctgaatttactcaggacttaaactcaatacaataacttataatctgaaattacttatttattataacttcaactttatatccatctggatcagttacaaagtaatatcttggtggttcccctggaagtcccttaaggtcagttacttcatatcccatttccatatgtttttctcttaatgatacaatatcatcagctccaattgcaacatggctaaatccatttcctaaatcatatggcttttctggatcataattataagttaattcaatttcatatccgtctggtgtatcgcttaaataaactaaagtaaatttatgctcaggaaaatcctttcttcttgtttctacaagacctaatgcattcttatagaattctaatgatttttcaaggtccattactcttatacatgtatgtaacattctagttgccataacaatacctccattcaatatcttcaattcttattatatcaaaataattatataaattatactacaaataatggataatctttccgaataaaaagtttaatattaatttttataacttgaacatatatgttgaaatatgatttgctcataatctaatcatacttgttatatatttatgctaaaatttaaattttcacctaaaattttatattttcataagtaaattattttttatgtattttaatgttttttcttctccatcttctgctagcattttaagaagaaattctaaaaattcacgactttcaggatgaattacataatagtcttttctttcttcataatactcaagtgcacttttatcagtatatttttctccaagatagtttttagatgcactcattctatcaatgaacatttctataacatactgagatggcatcttcattccttgaagtccatcagaaagcttatttccataatcaatccaatattcaaagtgatgtttatttctacctttgtgatgaagccatgctgttgatacaccttcttctaatttttgaattccatttggacttacatctcctcgataatattttatgccagctgaaaattcaacaggcttgtactttgaaagatcatgtaaaaatccctgtttgtatagacctaccttaaagcaagttttcatcacaagaattttatgattcgttatcgtcttaaaatgtccaatcatgttttttatcataattctgtatctcctgaacctaattatattatttaatgtattgcaaaaatcacttgcaatttttactcttttaattatatatctaattatgaccattagaaagaataaaaatatatatcctatcattacttagtttcttagatataatgttatataatttatacatttaataattctaactatatatttcattattaagtttaaaaattattagtttttccatttacatataattttattaattatatgtattgattttttttatttcagtactataattgacttaagaaaatgtttacaaaagcaatttctgagtaataatctattttttgtatgatgcacatcttacaatgtatacttaataacaaacagtactaagcttcatccccacacacacatcttagtactgtttgttatttatttttttatatatggtataatttaatttagagtactatgttaagtaaaacactcagactattacattataacaaaggagaattatgttatgatacgatttgaatgcgactacctagaaggagcacacccaagaattttagaagctttaactataacaaactttgaacagacaccaggatatggaaccgatacatattgtgaaaaagcacgttcaataataaaagaaaaatgcaattcacaagaatctgatgtacattttcttgtaggtggaactcagactaatacaactgttattgcatcaatcttacgtccacatcaaggagtattatgtgcatctacaggtcatataaatgtacatgaaacaggggcaatagaagctactggacataaagttatgtctattccaagtgatgatggaaaaataactgcattagacattcaaaatgcttatgaatcacactttaatgatgatactgctgaacatatggtacagccaggaatggtatatatatctcacccaacagaaaatggaactctttatacaaagaaggaacttgaagctataagttatgtatgccgtaaatcaagtcttcctctcttccttgatggcgcaagacttggttacggtcttactgctgatggaaatgatgtaactcttgaagatattgcaaaattatgtgatgtattttatattggaggtacaaaagtaggtgcattatttggtgaagctgtagtaataactaattcatcattaaagaaagacttcagatattttataaaacaaaatggtgggatgctagccaaaggacgccttcttggaattcaatttactactcttttagaaaataatttatattttgaaatagcatcacatgcaaataatttggcattaaaaataagagatgcatttgaatctaaaggctgctctttccgttatgattcaataacaaatcaacaatttccaattattccaaatgaatatttagaaaaattaaaagataagtattctttttctttttgggaaaaaactgatgaaaaccatactgctgtacgtttttgtaccagctgggctacaaaggaagaagatgttgaagcacttatctcagatataattaaactttaataatatatttaaatttaatatgtttgtaaataagaataagaaaagaatgtagtgattttatataaaaagctacattcttttcttattttttatataacatcaccttacttttttagtatgctttatactctattggaaagttatgtatattatattttattatgctaataataggaataaaaggtggtgactaatatgcgtagaaaacataaaatcttaagaataaatatccctgcattattagcattattattgattatgcttttaatgcttcaataaaacaactatgtatcctaagttttataacttatataatattatttaacaacatattcttatctatatttcatatatttcaaatacttttaatataattattctataaacactttatatttgctggaggtttaaaattgccaaattactcatctcgatatgatatagttataaacgatgatactgaaaatattaatttagattttgttttacctaaaccaaaggaaaaaatgattcatggaaccatttggactgatgataataatccacaggttgtagaagatgcagctgtctttatatatacccctggcccaaaatactttgattcagatcctaatgatttaaaatgtatagattatgttcttccagattcaaatggtcaatttgcagctggtccattccctataaatgctacaataattttaaaaatttataatataaataatcgtcaaaatttagagctacctgatgatattcccgaagatttaaaatatatgttaaaggaatataactcttcatcaaaaaatgacatttctacacttgatgattaatattaatataaatcctaatctttctgagtttaggatttattttttatttgtaatttaaaagagctaaacaactcatatagtgttatagctctttcataatatttggaaagtctatttattatttattaatgaaatttcacctttctataagtctcaaaatcaaaccatttttccataaagtctccttcactcatattttttctatcgtctaatagtttttcaatttgatcctgtgaatttgcttttattgcaaagcctcttccattaatcactttataatttgaatacttatactcatcaattgacttaatagtacttatttttctattacgtactgaaattgcaattttatcacgaagtataagaatgtcaaagctttcaggatactcataactttcaccatttactggaatttcatctcctattgtatatacctttgaggcaggtctgtatttataaattgaaaggctttctgtattataataaaattcttcaaaaatatcgcctctaccttgtaaatcattaaattcaaaagctatattatcagccttattttctttatgagatgaaatttcctttattactccacaagcagatgtcatgttagtaatcctgtctattaatataaattctcctaaattcttgtgtcttgtaaattcatctgctgctactttttctgaaagtaaaatattacatactgcaatttcattctttttcagatcttgtgtatttaaatgttcaccactgttaacgtctatcttgtattttaattctgtaactattccacttaacatctttgtacctatcttaacaatatattccttgccacatatcagttcagaatcatccatccacaatatctcagtggtgaatgagttgctaagtttaatatctgtaccttttagtaaaatgcagcctcttgatacatctacttccttatcaagttgtattgttacaggttgtccttttgatgcctcactaacccttttatctgtaacatgtatactctttacttttaccttttcattacttggaagagcagtaatttcatcacctacatttatgattccagattcaatctgtccttggaatcctctaaatgtatgatctggtctacaaaccctctgtaccggcatataaaaaccttcttcacatatatcatccacttcaacattttcaagatattctaaaagatgcatgccattataccaaggtgtattttcagacttagaagtcacattatctccttctgttgcacataatggtattgtaacaatattttctaatgaaagttcttcctgaagttttaaaacttctttttctatttctataaatctttcttcactatatcctacaagatccattttatttatggcaaatacaaagtgctttatccccataagttcacatattcttgcatgtctctttgtctgaacaagtactccctgttttgcatcaattaatattattgaaaggtctgcaaaggatgcacctacagccatgtttctagtatattcttcatgtcctggtgtatcagctacaataaaacttctattgtctgttgtaaaatatctatacgcaacatcaattgtaattccctgctcacgttctgccataaggccatcaagcaataaagaataatctattgcaccgcctctgcttcctactttactgtcaagttccaatgctcttttttgatctgcatacaaaagttttgcatcatatagtatatgtcctattaaagttgattttccgtcatcaacacttccacatgttataaattttaataaatccttcattttagaaatacccctctctctttcttctttccatgcttcccgccgcttcactatcaataacacgagtagttctttcagatgaaaccgcacttaatgtttcttcaataatctcatctaaagtatctgcttctgattcacatcctcctgtaagtggataacatccaagagttctaaaacgaactttcttattttctactttttcacctggaagaagtttcattctatcatcatcaaccataataatattgccatcacgataaactactggtctttcttttgcaaaatataaagatacaatatctatattttcacgctttatatactgccatatatctttttctgtccagtttgaaatagggaaaaccctcatgctctcgcccttatttatttttgtattataaagtttccaaagttcaggtctttgatttttaggatcccatgcatgtgcttcatttctaaaagaaaatattctttcctttgcacgtgacttttcttcatctcttcgccctccaccaaaggctgctgtaaatccatatttgtttaatccctgctttaatgcctgtgttttcattatgtcagtataagctgagccatgatcaaatggatttattccctgctttattccttcttcatttgaatatacaatcatatcaatgcctagttcctttgcttttttatcacggaactctatcatttctttaaacttccatgtagtatcaatatgcataaatggaaatggtggcttttcaggataaaatgccttcattgcaaggtgtagcattactgaactatctttacctattgaataaagcataacaggattttcacattctgctgctacttctctaataatataaattgcttctgcttctaatttatctaaatgtgataattgactcattgtttttcccccttaattatttttactaatttaaaattatattgattatttagtcatttaattttttaaatatcatttttcataacgtactttacactatctatctataacttattactatcctaatatttatttgaatccttactgttaacatcaatggttttgatttttccttgaggattttcaatattccagtgaattatatctccttcatatttaacagacaatctgcttccacgtcctccaatatcagctccaagatatagagaaatagcttcttcattgcattcctttatacatgatgaacatccccagcagtcttttggatatttaatgtatgccttattattttcatctgcttttaaaagacttcctggacatacatttatgcatttcctacaccctatgcacttttctttattaattgatatgctcataagtctccccctctttcactaaatctctgaataatactgtaagctttccatcaataacttttgagtttacatattttaaatattcatcacttttttctctataatccagattttctgcaaaactatgccatctagtttcctttctttctctaagatgtgcaattacagatttacacacagtaagcctttcctttagctcgtaaacaaacattaattcatgcatgtcttctgctctaagcttatttgtcagattaattacttcatcaattttttcatctgcaatgttaagctgtttttcattgtaagcataatttctgcttatgcctcctgcatatgtatccattatcttctgcatagcttcttctaaatcctcaatgctaaataaaggtttatcaaaattcaaaaaatcttctgcttctattacctttttatctaaaagggatgattcatcattttctgaaaattcatatatactgattttttcttgtttaatctgtcttacagcctcaagtgctgcaatttctccttcaacaagtgcaccagtcacatacttctgtgggcatccgcctgcaacatctcctgctgcaaaaagtccttttattgtagtttctctcttagtatctacccaataaccacttgctgtatgaccaccaacaatatatggttcagtaccttcaatttcaacattctcatcactaggattttttccagattctatccactttaaagtctggcttggtgccatattaagatatgctttctttaagtcttcactcatctcactgcttatgccttctgttttcaaatagcatggacctctaccttctaaattttccattacagtcccataaactctttctgatgttgtaagtccatatttagtttcatagatctcaccttttgaattaacctgttttgctcctgctccttgagctattgtgccagtaggtgcaatggtgtccttgcatcttaatgctataaatctcatttcaaatgttgtcatttctgcaccattatttattcccattgcatatccagctccagtattaaatggaggataccacattttgtgtcttgaaaatccactattgtttggcttgtacaatcctgctgccccacctgttgcacatattactttttttgctttaatctcataaaaaacttcatcttttatgctgaaagcaaaagctccatatattttattgtctttcacaatatagtcagttacatttacatgattcattacacttacattggaaagcttttttattttttgtgataaaataacttttatattttcaccattgatttttatatttctgtttccccttgatacatattccccattttcatcttttaaaatgacaagtcccatattctccatgttttcagtgactttatttaacccttgtgccatagttaaaagtaaatcctcacgtacaatattgtctgcatccttttttgcatattccacataatcagaaggttttcttccctttgtgacgtatgcatttatcgcatttactcctgctgcaagacatccacttcttttaatattagctttttccaatattaatattgaaagatctgaagattctgcagctgttattgcagcatagcagcctgcagttccccctcctattataagaagatcagtttctatcttttcaatctttaatttctttttcataatcaagcctaaccaccttatcctttaatatttacacataatccatcaaaatatgtcgtgttaccgacaaaatccgggaggtgacagtcaccaacattagatgaatactgaatttctatcattcatagcactattttcaagcatgtaagctttattctcatcaaaggtataaactctgtaaatgagcacatcaacatcttctccaatttcaactggaggttcttcaagagaccttactgcacttaaaatcaagtttcctacacttacctttatctcaagataactgcctctaaatgatatatctgtaacctttccttcttctgttacgcttacatactgtttatattcattctttttagaaagtttaataaactcaggtcttattacgactttttctccaatgtctttcatatcaaaaccttttaaattcctacaaccttctaaaacagtagattgccctataaactgagctacaaaagaagtttttggatttttataaatttctaatggagaacccttttgctcaatagttccatgatttgtaattataatttcatctgcaacttcaattgcttcatcctgatcatgagttacaaaaatacttgttactccaaccttatttatcatatccttaagccagcttctaagctcatgccttacttttgcatctattgcagcaaatggttcgtcaagtaaaagtagctgtggatttggtgcaagtgctcttgcaaaagctactctttgtctttggcctccagataactgacttggatatctgttttcaagtccttcaagacctataagttttacaagttccattactttttcatgaatttccctcttgctttttttctgaaccttgaggccaaatgcaatattatcaaagacggtcatatattgaaataaagcataactttgaaaaacaaatccaattccccttttgctagcttgcacatcattaatacgctttccatcaattaaaatatctccactatcaggtgtttcaagtcctgcaatcattcttaatattgttgtctttccacttccacttggacctaaaagccctattaattttcctttttcaattccaaaactaacattatcagatgctttaaaactgccaaaattcttatttatattcttcaattccacatacattatttaacaccagcctttttcgatttgtattcaactatattttttaaaattagtacaataactgctaaaacaaccagtattgatgaaactgcaaatgcatctgtcagcttaaattcgttatataaaatttcaatatgaagaggaagggtatttgtttttcctcttaaatgtcctgaaatgactgatactgcaccaaactcacccattgcccttgcactacaaagtattattccataaagcagagcccattttatgtgaggaagtgtaatctttctaaaaatcataaaccctcctgcacccataagtgctgctgcttcttcttcatcttttccctgtgcatttaaaactggaagcacttccctcaatataaatggaaaagtaacaaaaactgttgccagaataatgcctggaactgcaaaaactattttaatattatgagcctgaagaaaactgttggtccacccaattcttccaaatgtcaatataaatataagacctgctattactggtgaaattgcaaaaggtatatcaattaaagtagttaaaagatgttttcccttaaagctgaatttagatactgaccatgcagcaaataaaccaaagaaagtgtttatacctactgctgtaatagttgtgataatagtaagtttaaaagcttttattgtgtacctgtcaaaaacagcatctttatatgcatttatcccattcttcaatgcgtatgaaattacaactatcataggcataacgagcataattccgataaacaatacacttaagcctattagaacattcttagttaagttattactatttttaggtttttttatgatatttttattaactgtatcatctatttttttataagctatcttatgatcaataagctcattatttttttctaaactaatattatttttctgtttattttttaatgtgcaattcttaatccccataattctgccctccttataagatgtgcttattgctttaatatattaattaattatttcccgaaattttatttacatatccctgtatcatattaataaagagtagtataagaaatgatactgcaagcattacaagtgcaattgaagtggcatctgcatatttgtattgttcaagctttgtcataataagaagtggtgcaatctgagtttcgtatggtatatttcctgcaataaaaactatacttccatactccccaattccccttgcaaaggctaatccaaatccagtaagcattgctggaaatatttctggaagtataaccttaaaaaatattcttttcccatcagcaccaagcatagcagcagcttcttcatactgcttatccatcttctctaaaacaggttgtatagatcttacaacaaaaggtattcctataaatatcattgcaattataattcctatctgcgtataagctatttttataccaaattttgaaaatatacttccaatccatcctgtatctgaatataaagcagttagtgatatacctgctacagctgttggaagtgcaaatggaagttcaataagtccatctaaaaatctttttccaacgaaatcatatcgtaccaatacccatgctaaaataattccaaataaacagttaataactgctgcaataaaggcacataaaaaactaaccttataacttgacataacttcttttgatgtaactacttctataaattctttaaagcttattcctgtacttgtaacaactattgatgccattggtattattacaattaagcttaataatgtaattgttattccaatggataatccaaatccaggtatcactcttctttttggcttagtatttaatatatcatttaccaattggacactctcctttctttgattctgccaatttttctttatctattatctatattattcttatagaattactatgatttgaattgaaaaaattttatatactatttcttagtatatatttcatcaaatactgcaccatcctggaagaaatccttgtaggcattatcccagccaccaaaatcatctattgataccatttttatatctaggttaaatacatctgaatatttttttaatatatccttattggaaggtctataataattttttgctgctatttcttgtccttcatctgaatataaatattcaagatatgctttagcaacttcctcagtccctctcttttttactgtatcatcaactactgctacagatggttctgcaagtacacttatacttggagttactatttcaaattgatctggatgttcttttacagataagtaagcttcattttcccatgcaattagtacatctccttgtccattttcaacaaatgttgttgtagctcctcttgctcctgaatctaatacttcaacattatcataaagctttttcacaaattctttatctttttctttatcatgaccatattgattatctgcatatgcccatgcagcaagaaaattccaacatgctccaccagaagatttaggattaggtgttattacactgacattatccttaacaagatcatcccaatctttaatattcttttcattacctttacgaactagaaatactatagttgaagtgtaaggacaactattattatctaatttgttaatccatccactatcaataagtcctgcattttctattgctgtaacatcatgagcaagtgcaagggttacaacatctgcttcatttccttcaattactgaacgtgcctgctttcctgatcctccatgtgattgtgttacaactacatcttgtccagttttttctttccaataatctgcaaatacatcattgtactcttcataaagttctcttgttggatcataagatacattagttatttcaacagaatcgctttttgaagtaccactatttgttccacttccacatccagataaaatacctactgttagcgttaatgataaaatgagtgatattaattttcttttattcatctttactctcctctcaacattctatgtactttgtacatatttctattttatttacttttcctatagatttagtaggaattaatatttagtatatacatctcacaatattttgtcaatatttttttgaatttttgtaaaaaatatctatatattttttaaagtattaaaaaaagccatttctatgatttagtttattaaattatttttaatacgtattttcacaattagttaacatataaatatattgtaatgttcatatattcaaaataatttaaaacttaattttgttatattgctaaaggaggatattttaaatgtcagatataaaattaccatatggaaaagaaaaattatccatcaacattcctgatgatcgtcttgcaggattgttagtatcaaaagctaattcttatacagcacgagaagatgaaatgtctctagtaagggattctatagaaaatccaatagatagtattcgtcttaaagaacttgtaaaaggtaaaaacaatatagttatgattgcaagtgatcatacaagacctgttccaagcaaagttattacccctgttctattaaaagaaattgaagatggaaatccagatgcaacactcactgtccttattgctactggtttccatagacttactacaaaagatgagctgatttataagtttggtgaagatattgtaaacaacaaaaaaattaaattcatagtgcatgatagcagtaaaaatgaagacatgattgatttaggtactcttccatctggaggaaaattattaataaacaaaaatgcagtaaattgcgatcttttaatttcagaaggatttattgaacctcatttctttgctggattctcaggtggaagaaaaagtgttcttcctggagtatcaagccgtacaactgttttagctaatcactgctcagaatttattgcagatgaacacgctagagctggagttttaaaagataatccaattcataaagatatggtttatgctgcaaaaaaagccaatttagctttcattgtcaacgtggtcttagatgaaaacaaaagagttataaaagcttttgcaggtgattatgttaaggctcatgaaaaaggctgtgaatttgtagatgcgctttctggtgtagacgctattccttctgatatagtaatctcaactaatggcggatatccattagatcaaaacatatatcaatcagttaaaggaatgactgctgcagaagcaacatgtaatcctggtggtgttatcataatggttacaaattgcatagatggtcatggtggacaatctttatatgatacttttgccaatgaaaaatctgaagaaaaaatcatgcagaaatttttagctacaggccgtaatgaaactgttccagatcaatgggaatcacagattctctgtcgtatactccttaaatataaggtcattatggtaacaaaagctccaaaagatatggtacatgctatgcatatggattatgctgaaaatgttccagaagcaattaaaatggctgatgaatatctagaaaagcaaggaaaaaagaatagtaatattactgtaatacctgatggggtttctgtaatcgttagacactaatagaaattctattgactttaaatatataaacaataaaaatgcactttacagtgcatttttattgtttatattagaatattagactgactatatatatatatctgataattccattttaactttttcactcagatcatctttattaaagcattcaacacttgttgattcatacttttttattggaaattttaaaataaacctactacctacatttatctttgaatcaacaaaaatagttccattatgtaatttcacaaaagattttactatagataaccctattccactaccctcattttttctatataaactattatcaagttgaacaaattcttcaaaaatattatttatattatccatatctattccaattccatcatccgtaattataatataaaaatgatctttaacttctaaatcaactcttatttccccatgctccttagaaaatttaatagcatttgataatacatttaaaataattctctcaaatttgtcaatatctaatggcattattaattcttcctcagttgtatcaaaaatcaaacttaaatttttactctttgcatatggaattacagacataaccaattcttctattaactcaactacattaatattatcaaatttcaaatcttcttctaaatctgatttttgtatatcaattatattattgattaatcttaataacctcttacaattatcatttataatattaaaattattcatgtatttgttatcatctacttcatttttataattgactctaagtaattgtattgcagacatgattacattaattggtgttcgtaattcatgactaatattagttataaaatgtgattttgctttattcatgtcttctgcagcattctttgcttttaatatctctttttcatatactcttttatatctaatattacatactaaaacaaaaattgtaatgagtagtcctattacaagtatactattacctattattatatttttatattttttgactacttcaataggatcattaattatttttgaccccaacggtaaatctgattttttaatcccaaactttcttaatgctttataatcaaaaacatattcattagcactatcatcaccaatatatatatcatttttatcttgtccatttaataattcaacagctatctttcctgcatcttcaccttgattaaaatgatttataacctttcctccaatactaccgtttcccacatcataaaatagaatattatatataggagcatttttacaactttcatcaataaacttattgatttcacttatatcacgaaaattgttatccaaaaaatctgttacataaagttgtattacagcattatttttatctaacccagataaagtattttttatctcttctgaggttttatctttagtaattatccaattaaaattgtattcatctttatattctgtagttatttcttcatatcgctttataccataactatctaaaaaattaattgtcttcacattaggattaagcttttttatcaactcaatattttctctaattgactctatttctgaaacccctgacataaaatcacattttagtgctcgattacttctttcgaattgttgaactcctaaaaatgaaattggaatgtttttaaataaatcatttctgtattttatacaaaattcagttgcatcatcatcaccagaaattataagtccaatatttccataagcttctaatttatacttgattaaattataaaaatgtgtttctgcttcatagctattaaatattttagagtccatatattcaatatttatattgtaattattgccaaggcctttctttattccttctaactgatcattaaaagtaataaaatctaaattaaatgaactaataaataatacatctaacttatcttctttgttgctagcataaacattactaccatataccataaaaataccaactatagatatcaaagttaagataatcactctaaacttattcatattttcccccaaaatatctaagattgcaccttttttaaatacaataaaaatatattaattgtatttagtaataatatttcatttaaagcaatctatttcctgtttttattgattattatatcattattatgaatttttttccataaagtgattatttttaacatttaggacataaatttaatgttataaatattaatctatttatagcattttgaacaaggttttaaccccttagcctctgcctcttgtaaagtatattgtgttggattcttcatattactgcacgtattatcattatgataaacctttgcattatttcctgctacccaaacagttttattatcattttcttgttctttaccagaatttttattaattatttcttttgaattattaccttcatctttcaattgatcacttttattttctgaacttgatttattactttttgatgaagatgaattaaaagttatattctttccatcacttgtagcaacaatagttccagattcatcagttctgtaaactttaatttttctttcactaaatttatctaaggtttccttattaggatgtccataatcattatcctttcctacacttaaaactgcatatttaggattaactgcatttaaaaattcctcagttgttgatgatttgcttccatggtgtcctgctttaagtacatcagactttaaatttaaaccactacttaacatttccttttctgaaacatcttctgcatcacctgtaaataaaaatgaattacttccatattctaattttataactatagaataattattggcatcagtgtatgtacttccattaggtcctaagattgtgcattttgcatctcctaaattaaaagattcacctaccgtaggtattgtaaatttcattcccttattatttactgcatttaaaagattttcaaaagtttttgttgatgcacttacttttgggaaatatacttttcctactttaaatgaatttattatataatcaagagaacctatatgatcctcatgagcatgagttcctacaacatatttaaattcttttatccctaaactatttatataattttttaatgtgttttcatcatcattgtttccagcatctataagcatattttcatttccatactgaataagtatagagtcagcttgcccaacatcaataaagtggactttaagcaacgaactactatcatcactcttagactgattcccacatgaaatgagcatacatgaaattatcataacgacaaaaatactcactaatctttttaaatttttcattattattttctcctttattcctttgtttaatctaactttaatcacttctaaattacagaattaataagcttaaattatacaatatcagtattattataaagtttatggttattaaccatgtataaaatcatactatgattttttattatcctcccttctttccaaataattatacaataagtgcacaggcttatcaaacatacgttctttattttttattttattcttatttgatgctattaattaatatattctataaatctctaaataaaatttatctctttacaaatcttcccataaaatacacacccattgatgaaaattcaccaatgggtgtgcataaaagcatgattattaattattaataagctgtaaatccaccatctactggcataaatattcctgtaacattacttgcttcttctgaggctaaaaataaacaaacatttgcaacctcttgagcagttgccactctattttgtggtgatactgtttttcctgatactatattgctttctgccttaactccttccttagctgctttctctcttttatttttcaaaaactctaaagcttcatgatacataggagtatctgttgtacctggatttacagcatttactctaattccatttttagcataatccagtgccatatttctagttaatccatttagtccatgtttagatgttacataagcgctatgtcctggaaatcctattaagcctgcaacagatgatacattaacaatagcgccaccacaattcttatttatcatctcatttattgcaaagtgagacatatgaaaaactgacatgacattacagtcaaatactcttctaaacatttcctctgtcatttcatgtactggtgcaggcgttcctgtaatacctgcattattgattagtatatcaattcccccaaacttctttattgctgtatctacaacctttttacaattctctgctttagctagatccactattaaaaattccacattagtagtaatttctttaatttcatttaaggtttctctactcatttcctctttcatatctgctaaaaccaattttgctccttctttagcacttcttaaagcaatttcttttccaattccacctgctgctcctgtaattatcataaccttattcaaaaatctatcttttataatattcatataaccatacctttcctttctcataataattaatactcataaaatattatttatatttatagttatttttattatgaaaattctaaatatcttattaacaatacctacaaagaatcattaaatgtatttttactaaaataaccataaaagtaatataaatataatcacttacatattatacatgaagtattagaacttttaagaattataatctaagctgctaataaaaacatgtatttgttatttacaaaaaagatataacaaatatattcttaataactactatattaatatttaactttgtaaaaagtctaaattccaattatatagccattgaaaatgtttacttacttctggatacatgttaatatattacatataatatattatttaaaaggagatggtataaatgtctaatataatcatttcaccaagtaaatatattcaaggtaaaggagaactcaataatttaggaactcatgtaaataaattgggtaaaaaatctttaatcttagtaagtccttcaggattaaagagagtggaaaatacagttaaaaatagctttgctaatacggatacagaaatattttttgaaacatttaatggtgaatgtagcaaaaatgaaattaacagaataatacaaatatttaacgaacataactgtgataacataattggtataggtgggggtaaaatattagatacatctaaagctgttgcctactatacaaaaactcctatttcaatagttccaaccattgcttcaaccgatgccccatgtagtgctttatcagtaatatacagcgatgaaggagtttttgaagaatacttattcttacctacaaatcctaatatggtactagttgatactgatattgttgctgctgctcctgcaagacttttagtttccggtatcggtgatgcattggctacatattttgaagcaagagcttgttttaaatctaatgcacaaacatgtgctggtggctctgttacattggctgcaatgggcttagctaaattatgttacgatacgctattagctgatggattaaaagctaagctagctgttgaaaataaggtatgtactaaagctgtggaaaatattatagaagctaatacttttttaagtggaataggttttgaaagtggtggacttgctggtgcacatgctattcataatggatttactgtacttgaagaatgtcatcacctttatcatggtgaaaaagttgcctttggtacaattgttcaattagttcttgaaaattcaccaattgatgaaattgaacaaataatcttattctgcaaaaaaattggactacctgttaaactttctgatatgggtatagaaaatcctaaaactgaagatataatggccgtagccaaagcttcaacaacagaaggtgaaagtattcataatatgccatttaaggtaactgctgaaatggtttatgctgctatcttaggtgctgatgctttaggtaaatcatattcataagatattataaattccatatctatgttttatattgaacatagataatttaaaattcaaacaataaatgccagctaagagaatcaggattaaatttaattctgactcttaactggcatttaaaataatatttataacattaagaattaatctaatttaataaatttaacatagcttttcatcaaatatattatcaagatttactttttttactctgtcctcaatatctttaatatccaatgtgtaaagacctaaagccttcatcctcttaaaataacctgcacctgcaaatgtatatctatctttacgtccttcccttgttgctgccttttcatttgcatatgctattatatcacctatagctattgatgatggaagtattaataatggcattcccatacctagtcttactgcattgtgtcctgccagtgttcctgtacatattgcttctgtatgaccaacaaataaaccacttttttcacctgcacagaataaattatctactccttctactttcatatcattagtccttggtgctacagaaagatatcttattgaattacctttactacctgcatatggatcaacatattttgcattttctaatccttttatttttctcaattttggtagagggtagtaggttgtcattaacttagcatgacctgtatcaagaagaactatattctcagcaaattcctttaacgcatactgttgacatacttttgtttcaagctttccgtaatttacatcttctgctggaaccttcaaaacaacaacacccttagtttccagttcagttcttatttcatcagacaaactttcttttacaagtttacacgaacctgacatggcacctaaaatatcatcgcctctttctccctgaatgtcatttataccgcatctttgacttatacttattcttggaccaaatgctggacatcttaaaacacacatagaacatccatttccatatctcaaacagtttcccataggtcctgttgttcctgttgtttcaataaagacatctccatcaatataagatccatcacttaaatatacacctttaatctttccatccttaaaattgacatcattcactctgctttccatcataagatttatgccaatatcttttaaatacttacttacttcaccttcaatcatatttacattataaagtgttgcatgcttatgacctggaaaatctacatttctatgaacagatattttatctgtcatctttatgagttcaccgcctccaagtgcaataagttcttctgacgctgtatatcttccattatttctcattattccgccaacattaccaagaccaagtaaaagatctgttttttcaattactgtaacatctgcgcctgcttttttggcgctaatagctgctgcacagcctgaccagccacctccaacaatgataaccttcatataaatctcctcccctcaaatatggcccttggatcagcctgctccttacaaaacctttttactttatgtcctgaaaatctagctgtacaagctccgcatataccttctccgcagcacattttaaaattgttgcaacaggaaagtgttacatcatctcttcctatttccttaagataatcaattacatcataagtaagaatatctgcacctgctatatgaatataatctacaccctcatttaatgaatcccttattattacttttgcatactcggttaattttcctttttcaataagtaccttttcttttatttctaaatcatactcttgtaaaaacttatctgcaaagttttcactaaatggctctatatctaatgctgcagtaactttatttccttttgatataagtcttcttattactggcatcattggagctaatcctattcctctagctaaaacaagtacttttttattattctgagctttaatatttttaagtccaaatacaccattccagtatggtcctcttattactatgttttcattttcctttgtatttaaaagcctattagtcttaacacctctcatttctacggcaacagtaagaatatcattatcaatatcactattcattatagaaataggtatatcaaaataattattttcatcagtccttataaaaatataacttcctggctttacaagatccaaaactaatttgtgtggtgccttaaaattaatcatgatcactttatcatcataattagtcacttcagtaactgtacaatcataagttttacgtccttccttagctttgttaccattgttataaagttcttgataaacacatacacctttccaattcaaacaatcacagaaacattctccctgacattgtgaacaaataagacattgcccttgctctgctaatttacaagggcagtactctgttcctaaatcaatgcattcaacagcttcttttatcatgttctctccttttgataaaattgcttctcctatattagattatttaatttacttgagattgctacaaatatcttttgctaatatttgatataataaatcatttttttcattctaaagcctaataattaagattaacattatgcttttttattataataacttatattttattaacaataaaataagctacatcgttattttcagactataatttagtctttcaaataacgatgtagctattttttatattaatgcaatcataaatggaattgctatttttataaataaacttcccattccaattaaaatatatatgattggtgcagagttatttcccttaaaaatttccttaatttcggcaagtgccttttcaaaagcttcctctttgcttttatttaatacaactctattaattacaatttttaaagcacctattgctgttattataagccacaatataagcattaatctattgcttaaagtcatgtctttattaataataataaaattaagactaaaagcaaaacttaaaattgttgacatttcatatgctgtattaattaattttgcattaaacttcatgtatatccccaccttttcatattgtaaaacaattatacagggaaatatctacatgttttatttgtaaatatttcccaagaaatattttatactttactttccttttttatcttcttaagtgctttctttgaacctctttctatatcatgttcaagctttctctctttatatgaaacaaataactgatttaaatcatatccttgtggatataattctatagatttaaattcaattttaagtcttttataattaatttccttaaaatctccatctacaaaaactataacattattaaactgattaatttccttatatacaatcccactcttatttatatcaagtatagttaccttatcacctttttcaaaagaaacttcagcattaaatgatttttcttcactatttctttttattttactatcttttagtttttcatagttataatttttatttcccatatacattctactctttttaagaatactctcaggtattcccatcttttcagaaatgtatagagcattactatcaccacttttccctatatgaagtctatataagggttcgagtgtatcctttttaaattccattgcggcattttcaaagtgaggatgattttctgaaaaattctttatctcaccataatgtgtagatgcaacagttatacaacctttgtgataaaactcttctaaaattgctatagcaagagctgcccctcgttgggttcagttccacttcctatttcatcaaataaaagtaatgtattttttctgctatcttttaaaatttctgcaagattcttaacatgagatgaaaaagtacttaaagaattttcaacactctgattgtctccaatatctacaaacaccttatcaaatacagacatttcacttccttctctacatgaaacatgaaaaccgctcattactgcaagagtcataagtcctactgttttaagaactactgtctttcctccagcatttggtcctgtaattattagactcctatatgaatcacctatttgaaaatcaagtggtatacaattttcaataagattatatcttccttgaattatatttatatatccacagtcattaagccttggcttaattccatttatttctctgctgtattttgcttttgcaagtatcatatcatattctgaaattacgtcaatattaactttaagactttgtatcctatcataaatcatttcacttattgtagataaaattttatattcttcaacgctttcgtctgctgtaagagctacgagttcaacagtgtattttgaaattatatttggctctataaatacagtacttccttttgaagacacttctacaatacttccttgtacatgattcttataagctgcttttattggaacagtatatctcccatttctttgacttacaaaaaattcctgaagatattctctatttgatgtattcttaataaatttttcaagcttttctttaatcttttcttcacatatacttatttgtcttcttatctttttaagatcctttgtagcattagaatcaacaatactgccccttattgcattttcaatttcttcctcaatatatttaagttctgttatattctcaccataggaacttaaagtttctgcatatccttctttatccttaataaaattttttattttcctacaccctcttaagaagtcacatatagatgtaagttctgatggttcaagcacgccacctttatctattttatcaagaagtggacatatatcaaaaattccttctaaaggaatatggtatcctgcatctaaaagtcttcgtccttcacttgtttcatctaacattctatttacattttttatattactacttggatatagtttatctattaacttctttccaagtccactcatgcaataagattttacaatttcttttaatttatcataatgtaatttttcaaaagtcatattattcatagtttaaatttcctctttcattatatatttaaattcaagccatgaattctgtatagatttcataggtacgcaaaaaagctatggatacttccacagcttaaaatttatcattaacataaaacagtaaaaaatatatctaaatttaacaatttatatctatcaaacaacaatcattgtgaaactcttctaacacatttcatgtttgttgaaatcatataacgttatctctatttaaaatatataatactgtctttaataaagaaaattcatgacttgtagtatcaacaatttaattaattcaacaacaatcaaaggtataacaaaccccttttttgaattaatattaaatttattatttattgatactagacactcacaaaattccctcacttcatcttgaaatctatacttaattttaattttatattattgtaaaagaataaaattttaattcttttacaataatgatatatctttgttggtttttagtcaatattaattttacaatactttttttctaatcttgtttaatatacttttattagtaagaagttctgatgttattaatgatactaaaggaacagttaatattacagcaatacttcctgatatcccctgcattatttcaattcctatagagtacatattcataacttgattatactgcatacagtatgaatatgataaaatcaacgtattaattgatcctccagtaaatgcaagaattaatgtatttgacatagttcccatcatatcacggcctacatttattcccgatttaaacaattcctttttgctaagatcattatttttttcataaatttcatttattgtagaagctacggacatacttacatccataacagctccaagagatgctattaaaatcccagcaaacaatattcctcctatttgaagacttgtattatttcctataaaaataagttcttcaatatctgatacattgtatcctgatattctactgaaatatccaaatcctgctgcaaaagctcctgctattataacaccaattatagttccgagagttgcacttacagattttactgtaaacccatctataagatacattgttacaattgtagttaaaataacaactacaacagcagaccaaaatggggaatatcctttgtaaagcataggtataaaaagatataatatacacatgaatgtaaaaaataaacctattgctgactttaacccttttttgcctccaatagcccataacattaatacgaaaagtccaacaaatccataaattataggttctctatggtaactatatactgatgcagaataattatctccgcttgtacttaaatttaaaataacctttgtgttaacgttgcatttagccccataaagatatccataaaaacttgttgcctcaatagttcgtcctttaaattcaccactgagtacttttacctttatcttctgcctgctttcttgtgtatttttattttcatctacaatctcagtaacaattcctttttcgaaactcgttccttctctatttacaagctgaactctctgaaaattattaaaaaataataaaaatacacaaaatccaattcctaatgttaatattatacatcttcttatattatctttcttattactaaataaatttgcaagcatattcttgacctcctaaaaaaaccataggagcaagtttctatacttactcccacaattactaaaaacatctttctcaatattataattcttcttttgttttaatctatatactatctctgcttatgaattttctactttgttttagttattttaaatgtatcgtctattttttctccattatcagttctataagtacttattgaaaattctgtatcactaatatggattgtagaatatgttggaacatcttcttgccatcttgatgcaatatatgattgttttctagtaactaaatcataatacttacttcctgatgctgagtttgcagtcatataaagaattccttctggatcaactacattattaatatcaccttttgttgtctcaacagcttttttatcctcaacatattttaaatactcttcatatttttcatcactttcaacttcaccatcaaaatatttttcaaaatcatcttctgataataatttagattcatccttttctttatatccaccagataatatgtgagatcttgaatatgcatgatcatgaccagttaatacaacatcaatatcattatcttcaaatataggaactaatgaataccttaaagatactatttctggctcatttgaatgttcacctgaaccataaatatcttgatgcagtgtaacaactttccatcttgcatccttattttcacttacagctttttcaataaattctttgtgctctgcaatattataattatttgtatttaataccatgaaaagagtatttccatatgtataataataatctccgcctgctacagtttccccaagttctgaagcatttgggttattgaaatgatacgaataatttccacttggtgcatcatgatttcctatagtagttgctactggaagcgacttaagagcatctgcacttaaatatcctgcatattcaatttcattcttgtcatatgtcttacttggatttttcttatctcttgattgtatctgatctccagctgaaatcataaaacttatattaggattatcttttaatgctgtatttatagtattattccagttaaaactatcatttctagttgctttatcctgtccttgttcagtttctgatcctgttgctatgtttccacttgaagaaccaatctgtgggtcccctacaaataatatatcgaattctttagtacttcttgctctataagaaactggttcactccattttccatcaactgtataactataataatatgttgtattttcagttaatcctgtaacaatacacttattagatacatatccactaacagcttcttcactagttacctcaatttcttttccatcttttaaatcagctttttttccaaacttaaatcttggtttttcattagatttttttgaataccatgaaaagttaagttcagtttcatctttacctggtgttaaagaaacctgtgtaggattattctttatttgttcccattcatcacaccatttttcccattctccattgtctgctgctgatgtcttactagcctctgtccatccatcattgtctgctgcaaatacccctgcacttgcacttaaaacaaccgttaatgtaagtaaaatagtcattaatttttttgcacgttttatcattattactcctccaaaattagcttactataggattatagcttttgaaattagtggcaattaatccacaaaaattattatacagaaatttaatggtagataaatgtttgttaaaggctttttacgtattttaactcatcttttacataacatgtaccattcttaacatttctaattatttgcaaaataaaaaatcatatgtgtaataaaactaaaattacacatatgattttcttattaataatatatttaatttttattgaactctagggataattccagttataataagacctgcccattctttatcctcgtattgaatccattcacattcaacatcaagatgtttaagccatgcatttaatccataactttttttacttacatttggacactttcttccatggatttcttttatgtactcaagaagatcagtttgctcatctctaccaagttccttgttcataatatttcttatataatcaatacattcagtataagccatgctgtcaacaagatatatttcatctgcatgaacttgtctttccttatttaaattatccataatttcatttatttcatctttattgcttaaataatgtttagctcttcttaaagcttcaatatcattatctaatttgttaatctttttttctaaactttcataaatcatactattttctcactttgctataaattttattttcagtcagttaattatatcattaatatttctattttcatatgatttaattaactcttaaatacttaatttaaaatagcatatcctcatcaatttctttgcattttctctgtgcttctggaacatctaaaataacttcaaaaaaatatcttgatatatattcaaaatcaaatgagccatttctaaagcaccatctgactgctgtagcgtgtaattgctgaaacaatagtgtcacaagtacatcaggtcttgttttatttaatatttctccattttcttgagctttttttacaatatcaatttgaatctttaaaatctgcttacggtcattattaaccttaaaagttcctatattgcaatcattaagattttttatgactatttgttttactatggtaactcctgaactttctatgaaatcaatgaaaattttatttagcatccataatttttccacatttgaatcagctgtcattattgttgccaaatcattagatgtaagctgacatggtattttataatatttatttaaaaggtcatcctttgaatcaaaataataataaaatgtatgcttgtttataccacttgcttcacaaatttctttaagtgttacattatcgtatcccttttcatttattagatttaatgcaaccttcctaattttcttctttgttgcattttcatactgcatcattaaattctcctccctgtaatatattttcatagtagcaatatttaacactatagtcaatattacaaattactatagtatatttttttaataacctatttacatttttattatactgcggtatcataattttcatatattaggtatcaaaggagaattttagaatatgattaagctgcttaaatatgccgaaccttatattctgctaatcattgccgccataattcttttatttggtcaggctatttgtgatctttcacttccagattatatgtctgacataataaataagggtattactgtaggcgataaaaattttattataaaaacaggctttaccatgcttggaatttcactacttagtgcagttttcactattattgttagttttttagctgcaaagattgctgctggaatgtgcaggacaataagaaatgacctgtttacaaatatagagacattttctaatgcagaatttgataagttttcgacttcatccctaataacaagaactacaaatgatataacacaaattcaaatgcttattgttatgagtataagaatgattttttatgctccaataatggcaattggtggttttgtacatgctcttgcaaatagtaaatccatgtcctggataatcgcattagctataatatgtcttcttggtcttatacttactatttttacaatagcaatgcctaaatttaaaataattcaaaaccttatagataaattaaatcttgttgttcgtgaaaatcttgatggaatcctagtaataagggcatttaatactcaggaatttgaagaaaacagatttgacaaagcaaataaggatcttacagatacaaatttatttgttaacagagttatggtatcaatgatgccaattatgactttaataatgaacttagtaacagtgttaattgtatgggtaggtgctaaccaagtatcaggcttcaaaatggatgttggtgaaatgatggcatatatgcagtatgtaatgcagataatctttgcatttctaatgctttctatgatgtttattatgattccaagagcttccgtatctggtgatcgtattgctgatgtacttgaagctaaaacatcaattaagaataataatattgcctctaaaattgacaattgtactggattagtagagtttaaaaatgtttgttttagatatcctggaggtgatgaggatgtactaaataacatcagctttactgcaagacctggtgaaacaactgcatttattggatcaacaggaagtggaaaatcaagcatcataaatttaattccaagattttatgatccttcttcaggtgaagtattaattgatggcattaatataaaaaatattgatcttcatgagcttagaaaaaatatagggtatgtacctcaaaaaggtattttattttcaggaactataaaaagtaatttatcttatgctgataaaaatgctagtgatgaaaatattctaagagctgcttctatcgctcaagctatggaatttatcgattctaaacctgatagattcgatgaaataatagcacaaggtggaaataatgtttcaggaggacaaaaacagcgtttgtcaattgcaagagctttactttcaaagccacagatagctatttttgatgacagtttttcagcattagattttaaaacagatgctgcacttagaaaagcattaaaaaaagaaactggaagttcaactgtacttctagttgctcaaagaataagtacaatcatgaatgctgaacaaataatagttcttgataatggtcacatagctggaaaaggtactcatgaaaatcttatgaaaacttgcaatatctaccgagaaattgctttatctcagttaagtcaggaggaattatcatgagtgaaaaaagaagtggccctcctatgggcggacccatgggaatgggtggaaaaatgggcggtggagcaaaagctaaagattttaaaaaaacaatgatggatttaattcattatctagaagattataaaggtaaaataacagcagttattattttagcagcattttcttcacttttttcaatagttggtcctaaaattttaggtaaagcaacaacaaagttatttgaaggtcttatagcttaccttttaggaacaaatttacttacagatttcccctatataagaaactgtattatatctttagtagtcctttatttaatatcagcattatttgcatacatacagggatatataatgtctggtgtttccatgaacgtaacatataaactcaggaaagaaatttcacataaaatgaataaattgcccttgaaatactttgatacacgaacacatggtgaagtcctatcaagaataacaaacgatgttgatactgtaagccaaacacttaaccaaagtttgtctcaaataataacttcaactgcaactgtaattggtgttcttattatgatgctttctatcagtgttcttatgacttttgttgcttttttagtaatcccattatcaggtctcctcattatgggtgttgtaaaaaaatctcaaaaatactttaagcaacaacaaaaatctttaggttcattaaatggacatattgaagaaatatattcaggacataatattgtccaagtttttaatggcgaaaaagaggcaattgaaacattcactaaaataaatgacgatctctacacttcagcatggaaatcacaatttttatcaggaatgatgatgccaattatgggttttataggtaatttaggttatgttgctgtgtgtattttaggaggttatcttgctgtaaaaaagacaatagacgttggtgatatacagtcatttattcaatatgtgcgttctttcactcaaccaatagcacagcttgcaaatatttcaaatacacttcaatctactgccgctgctgctgaacgagtttttgagtttttaaatgaagaagaagaagttcccgacacatcttcaccaataaaattaaattcagttgtcggtaatgttgaatttaaaaatgtgcactttggatatactgaagataaaataataataaataatttttcatcatatataaaatctggtcagagaattgcaatagtcggtcctactggtgctggaaaatcaacaattataaaacttctaatgagattttatgatgttaattctggtgaaattcttattgacggtcacagcataaaagattatacaagaaatgatcttagagaaatgtttggtatggtacttcaagatacatggctatataatgcc
